United States Patent 9,328,346 (POLYCOMB-ASSOCIATED NON-CODING RNAS) - sequence listing, part 57

SEQ ID NO: 12115 - RNA, 22928 nt, Mus musculus
cuugagcacagagucaauacagaaauguuuaaugguugaauuguacacugucucugacauauccaggaaggcaacuuuucauguuucaaaaauagauuugauagaaagacuuacaucuucauaaauagguaaugugaaaaucuccccaaugugccuggcacccuugggcuggcaagucugccccugcccaagcccugcaggggggaguuuggcuagaggcccacugcuggcaguauccugggacagggcaaccuguucagugugaaccagggguuucggguagauccccuccaguuggggccuguguccuuggggacagacuuccacccaaagagacaugaggucccuucucuaguaccuuuaguggacaggaccucucuccugcugcuaccacccuggcccuaccagcccuucuguggguacuuccuccccaacagcaacagccuccaccuguuccugcuguucaguaacucuucaaacaagggaagagauuaaacuucuauugccccagaggcccugggcagcuguuggcaggcagccaagccugcccaggggaagggaagcagcugguuuguuucuaaacgggcauugcuuauguucugguccucaagcccugggcaccuuccgacaaaggcccaaaggucgcucugagcacuuugguggggcaggggccucagcagagggccugagccuuggcacuacuguuagaagggacggaugcagcuucuccauagaagccagcuucaguccaggacucagggcccucucaggccacagaauuggggucaagggaagaauucauccuugcuaggaugcuggggauagggccuguggcuggggagggcccaucgccccucaaagaugugugcuuugggucacuugugggaguccgugcuguaagaaggcagguuggcugagagaccugggagagggggucacguuggccccagacauaacagcgagcagagagauaggcaggcuguggagaccaugauuauccccacuggcugagggcccugggccuggccuuccagaccugcaccuggcagugaaacuggaaccuggaaagugagacaguagggugguuacagggcagggcugggggagugcaggggucaaggagacugguguuugugcuaaacucuuagggcaggaccgcuccuacauaagggcacagggcaggaccucauccgcacccggcacccagggauugugaaagggaagugagguuaucguccugugaaugaagaaagaaauaaucuuccugguugcugggugagccacggggccaccagugaagaagcuaccuggccaagcagagcccacugaguucuguuccacuccagguuaggcccuucuggcaguccucaacuguccuaaugccgccacauaaauacagcccucauggugugguaacccccaaccacaaaauuauuuucguaccuacugaacuguaauuuugcuaauuaugaaucguaauguaaguaucuguguuuucugauaggcaaccccugugauagaguccuuugagcucacuaaagggguugagacucacagcuuaagaaacacugccucacuggcuucauggcuuccagucuuuggaggcuagaaaagugggcucauggcccaggguggcaagugagccccaucaccagucaguugccaucuugugaaggaaaggguagagcucuguuuagggcaaaaggucucugaccucccucuucuaagcccuaaguacauuggaacccuaacguccugcugggcucagcacugguaucgcuaaagagcaaggcuugcuggguaguaguggguagcuauggcagggucaguaucuaaacucagagagacagacacauccuaaaaaugggacuuccauuugaacaccugaaccaaagaccuggcaaacuccccaccacccagcagggccaugagaggcugccuuccugaauggcucuggagacgucaaccccccagguucuacucauggaaccacagaugccagauggcucugaagaccaugugcaguacaaagggcaggcucagaguuggguaguacccacccguggguggagucaggcucugcaggggcggggucagggaaggaaccagcucucccugauaagaguuugagccaacugaaaccagcaagcaggacucucucaagugcaucgggcccaggaaaggaagacagucagcuguuuucugauaggugaccccugugaaaaggucacugccaugcccccaaaaggaucauacggguuaagaaagccuuacgggcuucaugguccccagcccuuagagccaugcagcucuaacccaguacagccacagugauccccaccugagagcacucagagcagacccugauuccaugccaucagagccaggcucagcuaguacacaggcugccuccuaccugaaggggaccccagugagucuagcccuguuuaucuaguucaccacaguucugucucccugggcugccauguagcuguugcaaagugcccuguggccagaucucccuaggaaaggugcugacagaucagaaugcuugaggugggaggcaaggguaggaugucagcaggaggaagaugcggggaacaacuccuucugaccccagcaggaagcacccguuaaggcaggcaggucucaggccagugggcacucgucuuuuuugcuuugaaacuguaagccagaccaggaccacagggaacuagaagcucuggacagucgucgcagggauggcuucuccacacggggcaaggcuggcauccauagggcccucaaccucagacacaccccagaagcugcuguucuguuguuuuuggugcugaggacugaacuuggggccuggcaugugcuaagcaugugcucuacccacgagcugccccucgaaagcugcuccucuguuguuuuuggugcugaggacugaacuuggggccuggcaugugcuaagcaugugcucuacccacgagcugccccucgaaagcugcuccuuuuuucuuaaaccuccacuuuccuaucucacccuucaaccacacugaaagauuagcugcuuuugcaaccugacuggcaacauuuugggccuuaagcccagagacaguucccaguuggccccugaccaugacucuacaauugggucagugaaaaugggaugcuacauggaaaagaaaacaucugagaggucuugguaaggcaucgagccaggcccagggagcucggagcuccaagcuggcagugaggacagaugcugaucccaccugaugggcucaggccuccccgggacaaggcucggcaccagucugugggucuaauugaugugcuuuuuauacuuugguaagaggcaggagaaugaccuggaagaaccugggguaccagccacaucccuggagagcagcaacccacugcacgucugcagcagucaaggcaggagaaggucaacaccagcacgaggcaguugggcagcacagccagcccauuucccaccacagucuaugcuggaggcucaggcuaguccuggaaugugaagaacaucgagagagcagaugcuggcuggugggaugguccacauccugcccuggaccgauagccuucuacacaggauacccugcauagcaucucccuuccuacacagcauccaggccaggggugcagaaucccucuagagaagccagugcccgggagggcugacucugaaggguggggcuugacaggcuggagacagaggaggaggggaggucagcacccacagccccagcucuccgcaauguccuugcuguccagcuggauguggucuguguucuucucacugaacaugggaccuccgugccucaugaugagcuccguggccacucuggugaaggccuccuccacauugcuggaguccuuugcggaggucucgauggcacagaggaugucauagugcucagccaggcucugugccuccgccaaugggaccucccggaaaucggcaaggucugacuuguucccuguggagaaaguccaaggaaaacaugguaggagccacaggugccagaccugcacaguccuccccagcaaagccacacuaaaaguccccaggcaugaccccucccccagcuccaggguaacacugcuagguguggugacugacuuaaaauaguccuuuuuauuuuaaccuuuugaaaaaauguucugcacaugggaguuuugccuggcagccacgaagaccaggagaaggaauuauaugccguagaaguggaguauaggugaucugggccaaaacguaggugcugcuggggaaacucaggacaugagggagcgcucaaaaccacugagccagcucgccagccaugacuuuaaucuuuuuuaaucuaguuuuuggagacagguauagcuguggcuaacuagaacacccucuguagaccugucuggccuugaacucagagaaaccugcuugcuucugccuccugaaugcuaggauuaaaggcgagcaccagcacacccgccacauuuuaaccauuuguaacaagaguucgaagcugggccaugguggcaugaacguuuaaucccagcagucaaagaggauuaaagaggcaggcggaucuauugaguuugaggccaaccugaucaacugagcaacuuccaggacauccaagguuacacagagaaaccuugucuugaaaauaaaccuaaaauaaauaaauagauucauuaauuaagaguucucacuagguugccuaggcuagacuugagguuguuaacuauagcaaaccuccugccucucagccucuugagagcuaaggcaaguguaaccaccaagucaggcugccuguauuuuaaagcuccuacuuucagcuggcaagaugguucagugguggguugaggugcuugcuguuaagcuaaguaacccgauccaauccccaguaccuacaagcuggaaaacagacuguaaguuguccuguggccuccacacgugugcuuugauguguguguaugcccauacauacaccagauagaugacugauagacagacagacagacagacaaacagauguagguagguaggcaaguaggcagacgggcacauagacugauagauagauuuuucuuuuuucuuuuuuuuuuuuuuaauguuuaaaacucauucuaggccagcaaaauggcucagcagguacaggcacuguugccaagucaagccaucuggcuucaguucacaggacccacuuaguaaauagggagaaaugacucuagaaguuguccucugacuucuacgagugcauugcggugcaucccugcaugcucagacuacacacaaaauguaguuuuaaaaugcaaauaaauaaaugaauagaguucuuacucuauggcaacucaucuuguuuucuuuuuacugcuucuuccccucugcagagcuggggaugaaaccuauaaccucuugcauacuagcaaacgcucaaccucugagcagcaagccggccacaucgccuccucugagcaugagaaguugcgcugucugcggacacaccacgccuuaacagcuagaugaucuggugcauacagagacugcacagccaaccccagcacccuucaugccuuccagccucaacggugagucuaacuuugaauugacaaggggaauggguaucugcaagcuccuaguucagcuuccagcuccuuuccugucccagcucagccccucucuaggcagguuuaggaaagaaaaacggaaaggcagagauaaggcuugcuccaggccccuccagccuccaucccuagcucaccaaucagcagcugcacgauguuggaacccgcguacuuccucacauccucgauccagugaggcacugacaagaaggugcuccucuugcugaugucguacgcaaggauagccccauuggcacuucgguaguagcucugggugaugguccggaaccgcuccuggccagcugugucccaaaucuguaacugaagggguugacccaacgacacaugucaaagggacaggaagggcagccccacagacccaugcccagaacaguguguccacuaaagguagcucacagcaacaguccucugucagccuuagaaagacuggacuuagaaagacccacaguggagagguggcuuggagguucagagugguugcugugugaucccaaggaccagagcuuagguccuagcucucaccuacaaaccaggccucccacacagcuggaaccucagcucuaauggggcagagacaggaucauugaagcuugcuggcuucuagccuagucaagaaaacuuaagccccagguucagggagagacccugccacaaagggaauagauaggaagcaauaggagaguaccugagagagagagaaagagagagagagagagagagagagagagagagagagagagagagagacagagagacagagagagacagagagagacagagagauagagagacucagagauccaguaugaagaaagaaauagaaugggaugggggauggggacagggaggaaccagcuugccucacaacaagaggcaauucugcacugcguccuccauggaguggcucuccccuuaacccugauuucagcugcagaugcugaccaccagaucuggagguaaggaauuggcuccaaggcugcacugaggcuaugcauuuaggucuuuucucugcaagcucacuggguccuggucggauagcuuugggccugaugaguccacagcugguggugaggaagcuagacugggcagugugccuguugauccaccuuggccaaagcacaggguaaagggccuuucucugccauuuacuucuucauuuaacaaauguuaaugcccuauguuaggcacccugcuggacuaagcaauggagaggcagugugcaugugaugaucucugccagggcuagcuaaagaacaaauggccaagaagucucgauaguugauaagagauagccauuuuuaaaauccaaggagacccgacaaaucccaagcagaagaaacauaaugaacuguagugggccauagccaaacugguagggggugggggugggggggggaggaugaauaggaaacaaaagcaaaauagcuagaccuauacuucuuccugggucacagcagcaaggcuuuuguccuggauggucacuuccuuuuucauucuaaugaacgcucagucaacaccuccacagaguagccccgucuacucccucagcccaauuucuuuuucuuucuuuuuggacaguguuggcaacucaggaucacacacaugcaggcaauuauucuaucacugagcuauaguuccaacucagaccccaaguaaacacucuuugcuacacuuaagucugacauaacacagacucacagacacacagauacaaacacacugacacccagauacauagacacacacagacucacagauauacagacacacacacacagacacaaacacagauacacagacacucagacucacagauacauagacacacacagacucacagauauacagacacacguacagacacagacacaaacacacagacucacagaugcacagacacgcacacauagacucacagauacacagacaccagacacacacauuaucacugccccacccacuucaugugagccccaucaaaacaggccucuguuuaucugguuuucuauucucaggcccuagcacagugcuuagcaugagaagguguccaauaccaauaaaaauuggaggacggggugcugugucuaucccaggagccuggccuaugaucagacucaaagccccaguuucugacagcuaacugcggaucaauuugaguguuaugaaagcugagagccuuuuuuacugccaagaucagccucaaacugccaagaauaccuaccagccugacaccaccccagucccuaccacuacauggaagccuggcagggcuuggugcugcacccucucaccugccauacccugcgucucaaucuuucucagccgagccuucucagccuguaccugaccuuuaggagaaauucugauuucugauaucuagaguuguguccauaagcaacuguaggccagagcacuucugagucccaaugagguaaaaaacggacucccagaacacacauguuuauaagcaagguugggcgggugagucucagucccuucucuggcccuguaauggaaagacugggaaucaccauccucaguggggauggggcuccuaauuucuuuuaagucccacacuuaauaacucucagccaaugcuggcccacaagucuccacgaggcccugaugaagcaauguaccuguaucaccuaccuuaguacuagacucuucuacccauccucuaucaccuuggggcagcucucccugacacucgugccccagcccuaagcagaaguaacuccugugccugucucucuaacaacucaugccauagaacacaucuauuuaccaaguauccaucacgaugacuuuaggagcuaggcaaggaacaucagccacagcaacacacacacacacacacacacacacagagagagagagagagagagagagagagagagagagagagagagagagagagagaagcaggggcugcaagcugcuuuccagggauucauggcucacagucccacuggguaagucacauggcugcaguaaaucaacccuguuuauuagguuaaaaacaucacuggaaguucaguuccaagaccugugcccuguccugucccucccaauggaaagggagccuguccugaguaaguagacaguggaaaguuccagagaagagaaccuuggaaaaguuaguucucagggcaaaaauugagauggucaggcugacccaaauacgaguuccugagcuauuuuuuaugaugucuugggacgugagucaaaccaggagguagugucugagggcuccuccuccaaccagccuccucugcugugcucuguccucuagggaagagcuuaacugcagguucuccaaugcugcaaacgccccauuguguuauacuaacugucaaaaggcaagaaucauuccaagggaagugcaguaggugggcaaguucagccugcugucuggcauccugcuuuagaaaaagaggugaguaggugacgggaguuccccuggggcuggcauggcagccucacagcaagccagggaccuguugcuccagcuucaguagccaaaggcuuagcuuacgucuccagguccugaggcuggagguucacugcucuggguuuuaauuagcagccacuguaacccucaucucccacagcuugcuucacacuccuuaaugagauucaguaucuggagcuuuaguuccuacaguggugagugucacagcucucgggccuaaugugucuaggacccuggccccuuaagaccuggcagcuccucggaaaucuucaagcaacuguagcuagcaguuucucaucccugguucuucaaagccuucuaucucucuuugauaucuccauucccacauuucuaaccugguguucucagcaacucuucagccacccucuuacugcuccugcugucacugcuaccauagcuuuggguuccacccucaccucuucaugucaccaucucauucuacuuuacuaaugauaaggaccaaaagacaguaagaaaagcgccuucaggagaagccuugcauuugagcuaaugcugcaaccccaggguucagugcaaaagaguguccugcagcugaguauaaagugaacugaaaugacuucuuauauacccagaaaggcgcugugccaaggauaucugcaccaucgccauguuggugugguccuucaaacaaaucaagggccaugugugccucaaucacaggucuucugcugagccgccaguggcauguucccccuucugucuguccucuguggaaauggcugcuagaguucaccacgcuugugguggcaaaagucuagugcaagcuguuugaagcagucaggacgggggugauggcuuuggaguaggaggucugcuagagcagucaacagcuuuggcugcuguauggcuuccucaagaaauccaugaggccaaucagagccagcuacaugacugauaauccuccacucaaggcagacaggguaccaggcaaaguuuaauagcuaucaaaucauguuggccccuguagugcuucgaauagguuuggccuccuuacgcucauguguuugaaugucuggcccauagggaguggcacuacuaggagcuauggccuuguuggaguguguguggucuuguugggggaaguaugucacuguagggcugggauuugaggucuccaauguucaagcuacacccaguguggaacacagucucuuucuaacugccuguggaucaaaauguagagcccucgcuccuucuccaucaccauguuggccuguaugcugccauguuucccaccaugacaguaauagacuaaaccuuugaagcuguaagccagcuccgauuaaauguuaucuuuuguaagaguuguuguggucacgaugucucuucacagcaauagaacugcuaagacagcccccaaaucuuaacuuauuuaaaggaaaaauaaacauuauaaaaggguaucuaucauuaucacgauaguucacuggcuguauuuaacaguacuuaacucuaacccagugcccagaggaaaagaaaaguaagaacucauugaucugaggacaucggcgaggcagacaagcagggguugagaggagccaguaucagagagauauggacaucauguguacccagaauuccucccaggcccucaacaugguuuaucaaggcacggcaucaggaagcaccucagucccuugcagcgauguggcuccuacaugggaguucauggcaaugccaggaagcgugugacaaagggcagcuaugccagccuuccccagguuuccuuaucacacucugcgcagcgucagcucaucucacagccacacuaagagaucaggcccauaaugccuugcacccagacaagcagaacucagcagagggccuagagcugucagcaucucggaccugucaccuaucauugucacucuaggaucaaucuuuuuuguuucuuggguuguuuauauccagacuggccucaaacccucuauguagccaaaaguaaccuugaacuucuucugagccuucugucuccauuuucucucagucucaggauuacaggcaugugccaucauuccuaauuauucggugcaggggacagaaccauggcuuccugcauugcagcauguccagccacaagauuacuccuuccaucuucagaguuguauucccaaucugcagcccuagccucucacugugugcaaggcaaggaaaguuuuuucagcaaaucucuucagugaguuacaucucccacaagcaucaaacccuugccugaauguccgugaggcaaacaagucccugccucagauacccccuucuucccuuccuggaagcucagaccacccacccaccacuagccauggagccauagcaccaagagccuggaacacaggauccuugggcaccuggcccaguucagaugggcaccaccggaccaggacaacacccaauagaaggggcugucaguuccucgugagacugugccuaucagaagagccuucuguggcaagaauggcauucuuaaaguggaagccaugaguucugcccucauuggcccucagagucuccacgguaagucucuaaacucaagcucucucuauuaccagguaaggugauguuuguuuguuuguuuguuuguuugaaauagagggugugaaguaagcugggacuaugugcacucuaaacaaguugcucuaccccgagcugcauccucugucuccugggccuucuuaauuuuccugacauccucaguccaaugcaccacaugacaggcucaacucuucccaccucuucgccgcccucccugugcccugccacucugguacuaagaaagugacaccagcuugggaucuuagcuuggccuuggguccuucggcucuccuccacaucaaccucagaacgcagugcccggcugccucccaggccucccagaaaaagcugaccacuuuguuuccugcugcccucagaaaacaguggacacgaugcccacaggaucacgcuggccuggagcaauccauggccucaucucuccccacccucaagcuguauccacgccuuucagcauguuucuauggucuggcaugcauacagccauggcaucugaacccccucuguccccccucuuuaggaaugaauacuccuccauuuuccaacgccucccuucacccuccugucuccauagcccuggacaaggaggacuguugcuuccucugggcuuguccaagcacgagacauacauccccauguguccgcagcagcuauagccaccacagggcccugcacuauaguagcuaucuucacuaucaacacucuguccugcuauggcccuguuggcaccaaguguguccacugucuggcucagcguuccagacacuacagugacagaauuaaguaccaggugcugucugagaugggaccugaaggaaagagacugucucugcugugccuuuggcaaacaaauccugccucaguugcucagaaugggcugacugcucccaacaccccuucuucccuuccuggaaacuuggaccaaccaccuacaaccagcuauggggucacagcaccaaggggagaacuggagcacagcaucccucccaggugccuggcccaguucaguugagcaucauggaaccagcauucccaagagaguugcccacuucaggacuuggaccacugacugagagaagguacuuauggaaccaggaccaaaccacgagccagucacaggagaauuacuguccugauucggagcugcaguccaagccucuagucaacaagcacaagaauccacagaacaccagcuaggucccaugcagcuuccccagagcucuuacgucaaccaccuacugccccaucaacagccugaaacccuggaaagguuucuuucccuucagagcuuggagugauaccuugggccuugaacaggcuaagcacagacucuaauaaguaagcuaccccaaaggccauggcucucagcaugccaggaagcaguuagaguuagaaguuuacccuggcacuucaggaauaaaauuauuuuucugugugauuucuucuauguauuucacagaaauuuucagguacuucccccaauuuuuuucuacauauuucaacuaaauacaaacauagcagauauuaacaagucauaguuagcaaacugauauuuauucugacaacuguaauuuuugguggggggggcaggggggcucaugaaauuaguaucccuaagugggaagggaaucaguuucucauugaaacuauacaaagaguguuucuaacuuuaaaaccuacugugcuggaaacucaggucagugguagacuucuuguguucuguugcaugggcccuacacucaauucccagcacugcaaaguuaaguuuucaaaaaaaguaauuugggagcuggcagaagagcuuauguuaggccuuguauuugauccucagcaccaaaagcucacccaguuucuacacccccucagccauaccaauggcaaucaagcaguuagcuggcgugcaaugacaagcauucuuucaggagucgguuuagcagccucauagacagcaaacugccgccccccccccccccccgcgccagggucugaccucccuuaugcuguuacagucugaguauuagguauccccaaggcccauguguauauuggcuggugaccggcuuguggcacuaaugguaggcggaagaauuuuagaaaguggaacuugguagaaggaaguuggaucacuggacacaucacacacacacacacacacacacacacacacacuggucuuuugccugcacguauauaugaggauaucagaucccauggaagaggacuuauaguagugagcuuccaugugguugcugggaauugaacccaaguccucugggagagcagccagugcucuuaacuagccaucucuccaaagcugaggacaugagcuugagaucucucucucucucucucucucucucucucucucaucuuccuuagcuacaugcucccgugaugcauuugacuuaccagcccaaagcagccaaggaaaucaccuaagagccucugaaagugucaccuaaaguaagccauuacuuccucugauuggguuuuagauuuacuuaguccccuuaaaaagcugccacuucaaaaaucaaaaugggcugggcagugguggugcacgccuuuaaucccagcacuugggaggcagaggcaggcagauuucugaguucaaggucagccuggucgacagagugaguuccaggacagccagggcuauacagagaaacccugucuuggaaaaaaacaacaaugacaacaacaacaacaaaaucaaaaugggccagaguggcccuguguuaagagcacuggcugcucuuucagaggaccagguucaauugccagcacccacauggcuucuccuaauugucuguaacuccaguuucaggaaugucacaccugcuucugguuucugcagacacagacguacauaugacacacauacaugagggucaacauuuacacauaaaacaagauaaauauuuuuaaauguaaaaagagccaaguaugguggaguauaccuuucauccuagaacguaauagacagaggcaggugggucucugugaguucaaggccagccuggucuacacagcaaauuccaaaacagccauuguaacauagaaaagaaacccuaucucaaaaaauaaauaaauaaaaaaaaaggagaaagaaaggagaugagacacauuuaguagaugccugucauggcccacuacaugucagaauugucucaaggccugggugugcccucuaaccuaaagugaacccccugacuauuuuuuacuuuuuacaguguagggaauggaacacagggcaaguaaagacucuagcaaugagcuagaaccccaagaacugguuguauuuguuugguggguuguuuaguuucuuguuuuauuuuuuauuacauuuuauuuauuuuugugugcaggaaaguuaggagagaacguuugggggugaguucuuuccucccaccaugugggucaagcucaggucauuaggcaugguagcaagcaccucuaaccacugagccaucucacagacucccauugguugcuuuuugagacaggcuuugaacauacaacccucuugccugaagcuuaugaguagcugagauuacaggcuugugcaaucagaccugauaagcaucaguucuuagauuuuuacguguguucaugaucagcaaugccaucccaaauacagaauguuaaaccagcuacagugacccaugccuuuaauccuagcuaccuaggggcugaagcagaacaaucccuugagcccaggaguaccaggccaagcuaguaacauagauccuaucucaaaaucaagcugggcauggugauacaagccuuuaauccuagcauucuuuaggcagaagcaggcugaucucuuauacugccagugccaggccaggcagggcuacauaauaagacccugucuucaaauaaauacaugaauaaaugaaugaaugaaugaaugcacagagagagagagacagacagacagacagagacagagacagagagagcaaaaacauacaggugugacuaaagguuagccaccugacugaauuuuugacaucacagcuuagaacuuaaguguuuugaugggugcuguuccuuucagagaggguuccuucugaauguucaaucagccacaacacucuacauccagagucuuuuuugaaacccuauauuuuccucuuuuggcaggucuucagggguggaucugaugauuacagacaggaagcaggccacuagggccugccauugugucaguagucaacucugguucaaaugaaaccugaggccaacaagguggcucacaucagcauaggaaggcugaaacaggaggaacacuauccugccuagcacugcaggauccuggguucagucuccaguaccaaaugucaaacagcacacugaggacuggcuuccccuuuuuccauccaggaagaggagggcucugaaacaaagugauauauauauaaugaaggguagaagaggccgagugugggcaagcuccuaaucccagcucuuaaaacaggagggcugucccaaagacaaagcuacccugggcuguccagcaaguacaggccagccaggguuacauaacaagaccccgucucauccaaugacaacaaagaagauauuaaacaggauuuacgaagcuauuaacgacaaaagguucuuccucgugaacuuacagccggcuacagguuccuuaucuagcaggauuugguugguuuucuauugcaacgugaauaaagcauuuuguauucaaacauuuuagucuccaaggcaaguuuucucuuacccacaguggccauuuucaacacugcccaauucaacugaacaagcauuuguuuauaauaagcaccugguguuacaauguugaaacaauacugcucaucaaaauguacaacgcaagugaucuaugauaaccagauuuuauuucuauuuuuuuaauuuuuaaauaacauuuauuugggagagggaagugcgugugugccacagucguguggaggucagaggacaacauucaagaguugauucucuccuaccgugugggucccagggauugaacucagguugucaggcuuagcagcaagccccuuuacccacugaaccaccucacuggccccuugaccagauuuuacacugcucccaccucccucacuuguugcucuugugcgcuugcugccagugauggagggucuaacaguacaaggacagaaaaguucccgacuaggagccaaaaggcuaggcucccauucuagacauccgcauccggacuaccucuccuucccuuguacaguggagacacacacacacacacacacacacacacacacacgaguagagcaacgaucagauggagcacuucgugacaggauaaggugcacacacacaagugcugccccuccugcuacugaccuuuaaacaugucucaugcccaagugcgcaaagaaaccucgcaggagccagauguggcagcugacacccaaaauaccagcacuugggaggugaaagagaggcucacaaguucaaggucacucuaggcuacagaguaaaacuuuuaucaaaauaauaacaauaauaauaauaauaaaagugggggagggaaagagaccagagggaccagagggaggcaggucaguaacaagccgagaggccacccuuccugacucugugagauacuuccucucuuagacuguacauagcaucacuucccauugcacugacaauccacuagggcgaagucugugaggggaacuuagagaauggugaguuagaagaggagucaucauaugcccaagauaauaugugcuugcuucuacagccugcccauucucucucauucucucucauccuccucucuucucuucuucuuucuuucucucucucucucucucucucucucucucucucucucacacacacacacacacacacacacauacacacacacacacacacacacacacacacacacacacacacacacacaaacacacacacaagcgcugcgugaggacaguaagaacccucaggaggcaagguuuaguuuacaaugaggaugguggccauugguaucaagaacagauuucuucauaaaaucacugugaccuagaacgucucuuaucuaacaguccugcuauuucugagcagauccgaaaaagucaaauugauuuuaucugaauaggaaaugcacagacacaaaaccagauccuagacuggaaaaacugggaaggcaaacaaaaacuucuggguugggaguguaucucaguaggggcgcacuugucuagagugcauggggacccuggguuccaucagcaacacugauacacagacagacagacagacagacagacacacacacacacacacacacauuuccuuuuuccuuuuaaaccuucucuaucccuacuugggaaguaacaggaggagccaugaaaacaaagaacacucuagaggcggagaacagccugagucaaggacaaugagcuggaagcccugguccuaagugagcugguaucuccaccaaguggccagguggcccgagggagccauguaaagggaugaaauccuaaccaggcucccuauacccaggccugagugccuagugaucugcacaggcaacuuuauauaacaggccuuugugcccacagagaggaagugagcagcagcaggaaggcaguccaggcuuacagcugagcuuuccuggggggcaguaccuggggaaugaugaggaggagaagcaagcuggccaucccuacucauccagagagaagacagaagcaacaauaagcaagcccucuuauuuguuugcaucauaaauuuuggcuuuauuuacaauauacuugggggauuaaaaaaaagugggcaguacuaauugguuuuugcuuauugggcuugggguagcuugggaggaacaaaggaguaagggcaacuucccugugugucucuuauuaagucuuugacuuucuguaaucugaacuaucugauuacaucaucuauaaaaaagaaaaaaucuagggaggagcagcaagauggcucagggaauaaaggggcuugcugcgaagccuggcaacuugaguucccuccaaaggacccacacuguggaaggagagaagguuguccugugacccccacaagccugcugauacacaagugcaugcacaugugugcauguacacacauacacacaauaauaauaguaauaauacauuuaaaaacauaauuuaaaaaaaacaagccaggaaaaauuuaaauauuuuuaaacguguucacaguuuuucaacacccuucacaaguaggugaguggucacuagucccauuucagagaggaagaggccugaggcuaccagaaaggacuccaacagcagaggcagaaaggagacccaccccuucagacucuccaaccagagagaugaacagcauucagauccaugugcuauguccaguccucagacccaaaacaaaugcugcagccaccucaaaugaccauuuuaaaaggccugugaacuuccacagcagcuucugagaacugagugggcuauguuuuaaaaaauguaucgugugccuauaugugaugugugucuauauaugaugugugucacacgugcaugcucacacccuggugcacacaugccauggcacauauguggaggucaguggucaacuuucaggagucuguucucaccuuagacccuggguucgggcagccagggcuuuuacuugcugagucaucugaccagccugaauggcccuaucucaauguucccauuagcugauaaacacccugaaauauucuggugccagcucuuauugaaaauauuuauaagauuccuagguauaaaaauugguuguagugauagaugucugaagccccagcaugugggaaguagaggcaaagggaucaggaucacaaguucaagagcguccucggcuacauagugaguuugaggccagcccuagggagagagacagacagacagacagagacagacacacacacacaaagagagaggggggcagagagagagagagagagagagagagaggaaaaacaaaacaagccagcccaagugcaugcucggcucucagugagacaauaguugauuggauucaucagccuucagaacuuuggaacgaccuuucuaggcacagagggaaucagaaaguaagcacuguacccagaaggcagccaaauccagaguucagauccugauguugccccugacuuacaggagaccucaggugaaccaguuacuucacuuuccuuggcuucagcgucuccucuauaaauauuaaccaguaagcaagcauauagugaacauaugugucugaugcuggccaaagggaucugugucuuuaaggggcuuaucuccaacaggaagaaacaaauaauccaggucauuucaaguccagguaaguccuauaaacacauagacaauagggaaaaaagaccugggaggucaggggaggacucugggaaagcaguauucacgcuagaacccgaauaauaaaauagccacacaaggaucuaagggacacagggaucuaugacaagaggaaauagaugcaaaggccauccaauccuggacuauuuaaagaagggagcuauacagguuagaaaauagggcugaggagguauacaggcccaucucuucaaguagaauauagcacaguaguuguaaugggaaguaacuauagaaaaaaagaacuugacuaaauuuguuauucucagcuuuccacuauagcagaacucucuauacaaacaaguaagauugaaacacagaagugaguaagauaguuuuucccugacaacugaaacccagaaguacauaagauaguucugcucuugacaacuggaacacagaaccgaguaauuaugaugguuuugcucugaccgauggggaagcagagccucuaccuucuuugccuucccaacuccugggaacuuccaaccucagcagagcuagaacagcagcuggccugucuuuaagguuccucagacccuuccaaagcccagaucaggugggagacaggguuccuuguggagcuuaugcaaagagcccgaaguucaacccucaacaccacaaaaagaauaauuaccaguaacaauggccuccagccuguagaacacaccauuaaacagcugacucacaaccgcuuauagaaaggacaagcaacagagcuuugagguaucaccacacagaugcagcucugcugcucccaggcccucgaggcugccuccugggaggaaaagcugcagugaccaucaggaagggaacuaacuagcugcaccauaguguauugcauaaccuaagcucaagugcacaguccauccagggcugcacuaggugacagguuaucuucacagguaaacaggaauacugccccgucccuggccagucagcacagggauccagcacagggaugcugggcacaggccaacagcuuuucaaaggggacucaucgucuuuauguuucuguuuucauacugcgcuuugaaugcugacuacuggcauuaucggaaggcaccaacuugaccacagacauacuccacccauggcagcccuucccuggccaccugcuccaaaggaaugguccagaacagcuaaaccugccugccugcucuuggcccuuuuccaccucaaggaaaccaaaauacacugaaacccaaaagacacccaaaagaccguuuaaaacguugcaagcaaaucucuagaggcacaguggucauaaaaacaaugauuguugacuugcuuuuuuuuuuuuuuucuacacuaugggacaggagagaggcaacacccagaaauuaucccaacuuuauagaaacaaagaacaaaguauuccagccaagggcaacagagaacaggccuacagccacccaaaugagcagcgagccacaccagcaacagggucaaaagacucccauccucgggcuucacgucugaaaacacaagacugcccccacccaguucucuuuaaagcugucuugaagauccuugugaaccagaaaccgugaaaaacggcaaaggauuucugcaggguggaaaucaggaaaguuacuaagagccucugugcacaagaacagcgcuguguccuguccaggaugcuaccuuuuuuuuuuuuuuagggaggacagacaccuagguuaagaaacuugauuucauucaucacaaauauuauuuaucaaaucauugccaggacauugugacaaccacauccugcuguuucugcuggggucauugccaaaguuugcuucucucccccaccuuccgguaucugugaugaaguuuucgguuucuaucaacccuuagucggggaggccccccacccccaccccaacuccgcgcuggcccugguggaguggaguuccaccaccggguccauaaaagagaccgcggggaggcguggccagggaggaaauucugacaaaaacuuuuggaccuccgguccuagcagccacuacuuccuggucccucccggucacggggaugucguuauuuggcugagugcuccccagagggccgcgcagggaagggucugucccggcaugcguggcgcucacggaacggcccgcagguugccuuccaccgcaaguuguuucgaaggaguccccaggcugagagacgggggggcgggaguggggugcaggcuuccuccuccacgcucuggccgcccacugucaccacucccagagcccaagguggugcuuucggaccugaacccagcacggacaucaaggcccaagcccguucugaaagaaggggaagccgaaggacuggccgcgaaccgcccgccgggagcaaagcagcgggccgcgccgccucccaccuugacccgcuugcccuggaucuccagcgucuucauggugaagucgacaccgauggugcugcccugacgcgccgagaaggcgccggucuugaagcgcugcaccacgcacgucuugcccacgcucgcgucgcccacuaacaccagcuugaacaggaaaucguaguguucguccugaucucccgggccagggcccgccauggcuccgcgggaguccugggacgcaagggcccggcuugggcuaaggacagccgcgggccgagguccgugugcccuagccggcccgccgccgggcuacguggagcggcggcggcaccugaacgagcugcacggcggaccgaucgaccgucccgcuccgccccgccccgcuccgcuccggagccccgaggacucggcuccgcccgggagcgcaccgcccggcccuccgcagcucucu

SEQ ID NO: 12116 - RNA, 214302 nt, Mus musculus
cggcuagcgggcugaguggggcacugcgcggggcgcgcggcuugggguacccgaggccccccaucuuucucaggugcccggguucugguccaagucccaagcaguggaaggcgggcaagagggagucaugcaguccgaaucgggaaucguggcggauuucgaagucggggaggaguuucacgaagaacccaaaaccuauuacgaacucaaaagucaaccucugaagagcaggugaguggugacagcuggagggaggcgcggcaggaggcccaugggccccgcgccugcuacccugggaggagaacagucagucuggauagcucuaggacaaggaccccgugcccuugccuugggguacagggcgaccuggccccuggcauuuagggucccgcuuacagacgacuugcuugcaucccaggguaucugacaguggcauuuuggggacaccgcgagucucuugggauggcucauccagacguggggacccucggcugcagaugccagcugcugagcuagaugggggcuggggcgguacccggcgcgaggugggguaggaggagcaccggacagggacugugaucuggugcuaccaagagcaauuuuucugaagcucccuagcaggcugaggggcucaggagagggggaucugaugcuccagggcagcgaugaacuggccuggaggucuucccuuguagaccagccccucugggagauacuacucagagaggccucuaggugaaguucaccugagcuucaccuuucaccugccacaggacagcaccgaggagguguguguguguguguggggggggggggugaauaaaaggaggggaggagguugugggugggcgugucucucaagcugggcaagcugucuggaauagaagucuuuacaaaugcaagaaggaaggaaggaaggaaggaaggaaggaaggaaggaaggaaggaaagagagaaagaaagaaagaaagaaagaaagaaagaaagaaagaaagaaagaaacaaacaaacaaacuaccuuagaggucuguggugguugggaaugcucucuuggcaccuacacacauuuaauucuccaggcgcuucaagaacuuugggccuagagugaagauguucucuagucuggugccucccaacucuucaguaccucugcaguauccuaaucccucacgccacccuccauugcuacuugccuggcagaaucgguuaucacucucuuuggucccucuggacccuugaagugcuucuuauuugucauguuuacagagagggggauagucacuggaaucugugacuuuauuuccacccuuucaguugugcgaugaaguaaggcuaacaucaucaccuggugcaucaauugucuagggucuagaugagugagguuccccugguagaggggcagagggacucacuuucaggggccaggaaggcagaauugagggguggaaucuuugguuugggagacaaaaaggcugggucuuauaaaguggagacagguugcuuuccuucagggcugggacaggaccuugaauccagucaugggaacaaacucugggaggagcagaagcccuggcucccuggcuaaggcaggcuuuuugcacaugcuuguggcagaguggaaggaaauguguuaggcaucaagaugcauaaacucagccuuucacuaguggcuucuuuucauaauggcuauuugugugugaauguagauaaggguguauugggugcucugagagugauacuguguaaagcgcauuguugguuaugcucauuagagcuuuaucugcauguggcugaagggaccaguguuuuacugagcagucagucccugcuuuugcuucuauaagcaaaugcuuacaaggccagaaugaggggggcagggggagugugugcgugugugugugugugugugugugugugugugugucugaaagaaauuaauuaacugggcucuucauuuugaugguggcugauacauuaaaugaguuugagggagugaagaagguaccucuggggaaaaccaaugagugcccugacacucauggggaaggauuugguucuauucuuuuacccagucagcaagaauggcacgcaagagcacauguccucuguagcuagcuagcuagcacaggaaaggaaaaaugugggacugugggcauaaacggcuucacauguugguacgagcagcaggugccagguagcauggaguagauaugcguucuuugaaauaaacccguuaaauaaaauuugugacuaaguuucuggaguacguugacaucuuuucugacuguuuuugacaguuguccuaaugguauuaucauugacaucggugugugacuuuaaauguggcucagggccuucucguugacuguaguuugaagacuuugcuggggcaucccuaacguccugguuaggaaaaaguuguaaugaaaauuugcagauucucguaacaaggacaccuauccauucuauugucuccaucagcaguucuuaaucugugggucgagaccccucgggggccguucaacaacccuuucacagggguugcaugucagauauccugcauaaucagauauuuauauuuaugacucaugacaguagcaaaauuacacuuaugaaauagcaacaaaaauaauuuuauggucgggggucacaggaacaugaagaacuauauuaaaugguugcagcauuaggaagggugaggaccacuugucaagauuguuucagaauucacccauuucuugccuaucucucugcuguaacuuugaccaagucauugucaguuuuugccugaauuauugcagcaaucucuuaacgcucucagccuuggccaguuuuaguaauuuuaaauuuagugccacaguauucuuauuaaacugauuuuuuuuuuuuuaaggcugagaucugacugagucaguaacaugcuugccacacaagugugaaggccugaguacuuuuccaggagcccacaugaaggcaggcaggcguggggcuuggugguuguaaucccagcacuggggaggaggagaugcgcuugcuggcaagccaaucuaucugaauugaaaaguaagagauaaaagaugagaaacuguaucaaacaaccaaguggugagugacugagggagacaccugaagucggccucuagucuucgcaugcaugcacagacacacacccacacaccccuguacacaguguaccggugcauacaucugaauguguauacacacauacguaugcacaaaccacaaauuagagaacaaaccccuauggagaaccucagucaucacugugggaaguugugaguagccuuuagcagguagagugcagggaugugcuagcuucgcuacacuacccagggcagcuuccacagccaagaauccucugggcccugagcuaaaacucaaguuagaucaugcugucuucucuaguugaagcccuccacagcucuuuuuuuccccaguccuucaaauggcacaaugcagcauaugugucaggcugcccuucagcucugaccuuaucucuugcugcuuaucauucuaagcagagcccaggcuucuaccuuuggauauucauucauuauaccugccucugcuugggccauucuuugcccagacagccacagcuguaguacaaccuacccaaccaacuacuaaucuuccuuuuaaugugcccuuaauucucaucauauggauaguguggccuucuguucauaauuacucucccucuaaacgcucagucuuccuuauccggcuguguuucuuucauaguguuaauguuauaauuuacaguguaauuugaauauauaugugugggaacauauauauauauauauauauauauauauauauauauauauauauguguguguguguguguguguguguguguguauauauauguguauauauauauauauauauauacacacacacauauauacauacacacaccucacacacauagguguacacacacacacacacacacacacacacauauauauauguauauauagauauauauauauaucaaacuucagggcuccaaggugguaaggauuucucucugugucuuguuaacugugaaguccccagagccuagaacacucagucacaaggcuuguaauguuucgagauagacgauucuuuaaaggacuguccaaugcauaggauagugucugguaggacauauuuguuggacacacacggcgcucuccuucaguaaguuacaaagguaucgugguugcuuuuuguuuuuguagucacuauuguguuccuuuucaaguagauucccagcaggcuuucuucgaggaugaguuuccauauucuuuguggcucaacccagauagucacaaauauguugcugaacuuagauucugugagccucaucuugguaagacugacccguaaaagugucauaggaaaagacccuguagaacaggcccucgugaugaaugguguuuucaugggaaugaauucuccccagugggucacaggagaaacaaucacagugcacccagguuuacacacuagcaagucacuccagggauaugcagagcuguucuugagcucugggggacacauaggcaguaggucuuuuggacacagugcuguggcuuauggcucugaugguuuugcucugcagaagccuaaggcuugguagaugcugaugcucuuuuccuaggcagucugaggaaccgguuucauugggcccugguuuccuccuacaaauuuuauugcuguuucagacaguauuaaauuuccuucagauuagaaaugggaaugugagcgagugcuaaguuaaucauggcaagaugggaugcuacagccgugccaaguauggcuucaaagagagauguguggaguuugcagagaaagauagacuguucuguccuacacacaucacaagcacacuggcuuuuguggagauuuccccuucaguuuuuacacuaaaaaggcccuuuuauuuguuaaaauaauaauccaugcuuagcaagacaaaacugucaagacaaucucaaucucucccucuccccucuccucuuacucucucuucucucucccccauuccucccucccucccucucuguacuggcuaguuuugugucaacuugacacagcugggguuaucacagagaaaggagcuucaguugaggaaaugccuccaugagauccaacucuaaggcauuuucucaauuagugaucaagggggaaaggccccuugugggugggacgaucucugggcugguagucuugguucuauaagagcaggcugagcaagccaggggaggcaagccaguaaagaacaucccuccauggccucugcaucagcuccugcuuccugaccugcuugaguuccaguccuggcuuccuuggugaugaacagcaguauggaaauguaagccgaauaaacccuuuccuccccaacuugcuucuuggucaugauguuugugcaggaauacaaacccugacuaagacaaauugguaccagcagagugggguauuccugugacaaucugaccauguuuuggggaggacuguggaaggacuuuggaacuuugggcuugaagauccauccguuguuaagagcucugucggaugucauguaggagcuuggaagauaauguugagaacacugcagaagauggagcucugguuugugaaauuucagagggaaaauuaaagacucuuuucagggccauugcuguuuuguuugugaagauucuguaguucugguuagcuggggcugaagaaucagcugugauuaacaagauaccagaacuaccaagcaaaaacuuugcauuacugggacuauugaugcugguuagcuggagcuaagaaauuagcggugauuaagaagagaccagcaucauugaggugacaucuucugggaaguguuuucugaaagcacaaagaggcaguguuccagagauggccaaggauguacuccugcugcagugggacuugguaauauguaagggucacccaggugguacugguuuugaaggcaugaaggggucacgcaaagcagcugagguucgguacugugagaggccauggaaggccauuggugaaggugcagccucaguugcaauugaaggcccaggacugaaggggucaugcaguguuuuggagaugccaguaccaugagaugaccaccaagagcagcagcagcagugggguacaggcaucuggagccuagaggacgaugcgugugcuacaaagggccuggcuggagaaguuacccaagcccuuggaggagcccagaagaucgugaguuggaucccagacauuggacgguuggagauugacuuuugcuuuugauugugacugugcccugauauuuucccucuugaaggaagaaacuguuuuaguggagcccacaguuaagagacuuuuaauuguaaaaagacuuuggauuuuaaaagagauggauauuuuaaagagauugaaauuuuaagaauauguaaaggcugugggacuuuuaaaguuauuuagaucuuggggaugaauaagauuguaaggguugaggcuuacuagugauguuuuugugugucaaguugacaaggggucaauuguacuggcuaauuuugugucaacuugacacagcuggaguuaucacagagaaaggagcuucuguugaggaaaugccuccaugagauccaacuguaaggcauuuucucaauuagugaucaagggggaaaggccccuugugggugagaccaucccuggcugguagucuuggguuuuauaagagagcaggcugagcaagccaggggaggcaagccaguaaagaacaucccuccauggccucugcaucagcuccugcuuccugaccugcuugaguuccaguccuggcuuccuuggugaugaacagcaguauggaaguguaagccgaauaaacccuuuccuccccaacuuguuucuuggucaugauguuugugcaggaauagaaacccugacuaagacacucuccuucuccuuucccagcucugguugguuuguaucuggacauuuucuuguuuuuacuuauuuauuuauuuucuguuuuguuuuuguuucuggguuuuucucuucugaucugucagggcaucguuggccugaagacugaaaaccauguucuguuauuguguuuuucacuagcuagcugaugaucuugaucaggccuggggaucuccaaacucaguuuccccguggagcaaguaggagccuccuuccuggagaaagagcauuaacauuaacguuaacucugggguuggugcuggcccaggucggucaucauucugcaaaugugagugguugcagcuccucuuucuuagugggcucugacauccuggaaugugcuugucguuaagagauuguggcucacuuccccaaggcaagugcuguuuguuauguaagaaaacuuccucagucuuacaaguucuguuuugcuuuccuucucacaaagcauccagaaauuuguuuuuacauuuuacauuuuugauccaucugauaacaguuucuguagguuaaaaacugggagagggagcaucagcacacucauaaaaauccauaaucagcaugcguuuuccaguuugaguacaccaaaauuaauacaguaaugguggcuaauggagacuuagcauguuuaaugugucaaucucuguucagagggcuucugcgugaauuagauauacuuaaucucaggcuuaugagauggcucaggcuaaggcucacaaccaaaagacaagauauguuuaaucuuccaaaaacccaaagaggugcuaagaacuaagaacaauggugguacuaauuaugauguuaaaauuaucagguccugacuauaugccagguacucuuuugaacauaacuugugucaacccaguuaauucucacaucagccucaggcaucuguauuuauauuuuccacuuauuuguuuaccgagggaaacugaggcauaccaagcacuggauaaggcccugauuuaaacagagguggucuaguugaacccccaggcucuugucaauuagugugcacuguccuguacaagguaguguucgugauuaugcagaauccaaaguuguagccaaaaugcccagugaggugaggguuagcacacgugacccauccagugaccauacaagguagaguguggccugcucuggguaucagcaauguggauuuaucagaggaaccagcauugguaugguguggggcaguguuucuaugagcgaaugagggaauuugaguuugaccuucaaaguaaagcaguacucaaacagcggagaaggcaugagguagcaugaagggcuuucuccucaaugcuagcaaaggcugggugcaggcgggcagguuuaaggaacuauguuacuguuuggaucauggcuuagcuauuuagcuggugccucuggcuucaugauacguaauuucauggaaucucaauuaacuugccuacaagaugggaccaguagaccuuaucuuccugaaauugguguaaguuuuaaaacagaggcaaaaaaugaugcauaugggcuuaguguagcccguaguaccuuugaugaaugauagcagcucuuucuuuccugggaaaacuauaccauagcauugucuucccucuuaccaaugacuuaacucuuauagagucagaagcagaauagucaggacuaaggugccucaaccugccagauguuucagccucauuaugcagaugagcuuugaguaugauuagacagaacacuugauuaaagugggauuuuaaguguugguuuugccuguuauuggagauuuccucuucccgagugcugcuauuuauagaguuucuuuaaguguguguguacauuuaauccccuuugaguucugcagugcaguuugcacaagcugaugucuagaucugcuccaguugugcaagaaguggaaaauauccuuuuuuuagaacaggucacaugagcuuacugucagggauaggaccucaguguaaaaaaaugugucuugggagaaaucaaaguuacuaaauuucucucuccaacugcuuuguuuuagaacugguaguauuaggauaaauaacaggaccaaaaaauaaaaaauaaaaaaauccuugguuacuauuuuuuuuuuuuuuggucagcugucaagggcaacaagaaagagucucauuuguuuuugugugugugcuuaugugcguagcaagcauaaaaugugcuguacuguuaggcucgucuaauugaaguaaaucauaaaaacauguuuaaccacucuccaaguguggauuauuuggaggaaauuaucaagaaggcaacucagagacaauaucugugguaaucacaagcuuucaguagaacacaguaaguuuaugguucaucuggaaaguuuucugugucuuaauacuguauggcuggaggggcaaaguuacaccaagacacaaagucuacaccucuguugagacuguagggcuggacuguccacuauaauuuccccucccugcuuuggacgaaugauagcuuuggauaccagcaucuuccaaggcucacuuuggcuucuuaucaguaagcccauuucuccagguugcuucauaaacacggcucccuuguuucuuugaccaguguuuucuucuguguugggucaagcaugcuguggaggaugaagggguuaucccugugguauucagaugagacccuuggccugagauuccagucacgagccuccuuuccuuccuaaugacugcuggguacuucacaaaugcuaggugcugugguccaggcacauaggcacaacagacguagccuuggugauuuucuauuagagcuggaaguuggucagcucugaacagcagagcuguggggaaggguaauaaggauucuuagugagaaaagagucauagggcugaauguccuaccucaacuucaugggggcccucuuguggcccccucagucccugcccccaucagucacucagucacauuaagcaggagaaacauagcucuggagcccaaaggaccuggcuguguuuguuuuucuucuuauccacccccccuuuccuuccuccccuuuacaucaguuauuuauuaagcauuucuacuauguuggagcucuugcuggcugcagggagugaaauguaaauuagauagccaggguuuuuuacuagcacugcaccuucccucuuggagguagggaccucuaaguuaauaaugagccaaagaauugaaaaaggcaauuuuugauaccugcagugaaaauuaagcggaguguuauugguaaaauguagccaaaaaagaagcagucuuuguggggucccaccagcagggagggcaccgugaaagaagugcuuuugaaguaagaccugacauaaugaggaaugucugacauaaagaugcuaccuaccacucuguggcuuugaccaaguuacucaaccucucugaacuucaaguuuucucuugaguaaaacaaccacuuugccauguuucuacaaaacuaaaaggcauaauguuuaaaaaacagcuaacaucagguuggcauucucucuggaugccuacuuaggaccgauugaagguaagauguaaaaaaacagaaauaauaggcauggaucuuuguuguaaguauuuauagcuugguuuuaagcuuuuucuuaguauuggaugagucaaguuucaugcuugucguuguaaaguuagccccccgacuaagaguagagcugggucuugcuuuuuauuauuuuuuuauuuccuucagaauggucuggcuuggugugguggucccccuugugucugcacugaagucacaucugacccugcuuagccuaggaaugggcuuuuggcugggccagggguuacauuuuugguuguaaagguaaggucugaggaaaagaggacucaacagcaaauuucacaaaacccgcccauccuccugacucccagccgugagucucagcaagggauccugccucccgacagugaagcauuggugauggugcagaagugaaaagaagcugacuucccgggcuccucccagcucucgccugcugaacaguagcuuugaacguggucucgugaaaaauaguauuuuucaaaaaucauuuggacuucgauagcuguguccuuuuauucacacauacacggaauggcaacuuuuaagaggaaagaugcuguaucaugagaaagcaaacguuuucaaucuaaaucagugaguucaggucuaggggaaggcaccgauggacucugguucuucuauaaggagcuguggcucauugagcaauuucaggaagacgugugugggcuuugccuuccccuacccugccccuuccccaacgugagucacuugcugaaucauccacacacauucccucacuuuccaucugauccaggacagcauuggaaaaagugguuuccugcccuauugaaaacacgcacagcuuauauuugcagacuggauacuuucaucaggaaaaguguggcuugucugcaagaagcuguaaagcagagaagaucaauuugguguaauggcuggggugaucuaugaacuuauaaaaugucaguuagagucaccguugacaugggaaccacaaacaugacuuccuuauuuaacucaggcaccgaaaccauccagguaaagucugacagaagaccuaggugacauuugaccccuacuguucuuuagguaucaacaaggucucucccaaacuagcagagauagcacucuacaguuaaguuaguaaagccacuccugguuauguccauggucaagucucagcuaccuuuaucucucagcuuuccagcagaaaugaagugaauuacaccaguaccagcuuuccccuguuguuucugagccugcagauuggcacuguacacauuuaguauauuauauugcucaguagaacccuuugcaaccaaccaauccauuaugcauguggcugagaaugacugaaugaaugacuugacugguaguaugaccaguuaagagucuuuaacuugcaaaggaauagggugacuucagcagucagugcacucuugaaaagucuguuuuuaaaguaagcacuuacaauaaccuaggugaagcaagcccaacagccaugagcagcuggugcaguuccuugugacaggcaugucugcccauuugcugugaggaagcacacguggagaguaauuugagagguuggccacugacggcagugucccggacagucagacugcagacuuuuuggaaccacaccuugcaucauucauccuagcaugguaauuuccccucgucaucccacuaauaauguuuugccuaggugaaugcugcugggugagcaaguggcgaaugacaggagcuuggaaugcagccccagugaugcagauuacagguagaagcuuugcuuuuguugaguuggaagugaaugagagauggcugauuggguuugcuuggucaucauagcaaagucaccgaaauacacaauuuaacagaaacugugauuuuuuuuuuuuuugggugugggggcguggcaaggggaggcucagugauacucuauggagcuucauugacuuugaaaaccccucuuugucucucuuggucccccacaccugacaucauuccaguuaguuuucccugguagccagcaucccuucccugacaccuuucuucuacuggacaaucacuuuucaccuaugaacaaucucuuuccccacauucagucucucucacauggucagcccuuagaguugaacuucaugaucaaugucguguccuuaguuucagggaugugcugacuagugaacccuaaguggaccccaagauuuccuuggguacugccauaucacucauguagcucugguagagaacuuucuagagagaauuacccuccuuccucaagcaaacaaacaggugauuuuuuuuuaaaucaauaaucauugauuuucuuggaucugacaauauaucaacacuccauaauuuuuacugaaggcauucugugucagggaauuguucauucugaaacagcaauccaagaauaauuuaacauagagguaugggguuuaugggaauguaccugaacagugauuuauaauaagugugcaucacugaaguauaccacacuuggggaggggcaccucggaugcaccgccccacuuucugaucuaguaguccaggauaggguuggagaagucauauuucuaaacaagcuucuaauuguugcucgggugagggcuugggguagaggccacacuucgaaaaccaugaauaggugcuagaggguaaccuuucuaaaugaacuugaaauagaaaacuugcaaagauguugguuauaaauaauguauaaugacagaguuggccccugucaggugauagaacacucauauucaucauguuuaaguagaaaaggaaacuguuggugacauggcacaaaaguccagggguauggaugacaggucuacccaagaguaugacuaucugagugacuugaaauucaccuaucuuuacuccccuaaggacuggcucaaaucucaaagugaggguaguuucuucucagcucugcgaggguggaacuggaagcaguccgaagucacuugacugggagauuggguugagaaacagggugauggugguuuggggcacguccacaugaccgaauuguuuuccacaaaacuucugcugaauaaaacgugaaauacgacuuucggccuguuuucccaucucuaaugaauuccagacaguuuguagagugugggaguuuccaaaacagagagguggaaugacugggcucagccaguguccuuuuuauggccacaagacagcccugacauagcagacgcuugcuuccucuuuguucuaagccucagcacacuucucauuccucugauuggaguggguggguggggguggggcuaugaagaaggaaggacagggccaguguugggucagacaaauuaaguuccuaagaaaguuccagacucaggauuuaccagaaaugcaacuugugccuggguuuaaucuacuuagacccaaauguuuuggauuauguguuuuugcuguuguugcccaaugaacuucuccagagaaagaacccucaucugcucugaccauaaaauggugaagaguuuucaccaccacuucaggaagucuaaauuuaggagaagguagacuugaacuuaaaucucacuuuuuccacccauuaucugagcacccugagcaugguacgacgggguggggguggggguggggagcgccagcuucagugcaggacugagaggagcuaaggaguuggcaacaacacagcaugaagcuuuugugugaauucacagauuuguagggucuggggacauaguucagccaguacaugcuugcccgcuuaagugugaggaucugaguuuggucuccaggacccauguaaaauaguaggguguggugguguguguuuauaaccaagccuuaggagauagagauagguggauccaggguuuugcgugcuagagggcucagucugcuuaguaagcugcaggccaaugaggcccccccacuccacccuagaauaaguggauggcaaccgaggaaccacagccuggccuccacaugcacuuguacacauauuccacccccccccccacauguaucuguacacacaugaaccuucucacauacacauauagaaaugugaagaaacauaugaguguaguggucugccaaauccuggcuguuagucccuccugguucccuucacacauaucaccaauuagguuuuuaauuugaaaugaauuuucaguuuugacgccacaauaaggagagaauaaccaagaacagucaagaagagaaauaaguccauagauaaggcccccauacaaucuccacguuguauaaucagcauugagaguugagccaggucaaauaguggggacuggugggaugccucagagggagauauuuaaggcuggcacgagcuauuuacauacaaggcguuguuacccuuugucgccagugcagucuuugucuuuaucaacauguuuccuuucaucauaauuacagagcaugacuggguggagaacgcacaagaagaggcacuaauuggaguugugcaauaucauggacgcucagugcacugcuguugucuguacaggcuccugcgauugcuaacugucccuauccagucuuguccauguugccuuucugcucucuggucauacauguuaacagcaucaucuuuuuacauaguagucauauuuauucaauaccagucagaagaccucauaccaaacaucaggaucuuuucaucuuccuacaugccuuaggagauuagaaacugaguuuaaaaugucuguguccuaugccaguaugauugcauuucuuggccaucaaaauugcucuuucugaaagugguggauaacuaguauuuagaaaauagaaaggaguuaaccuggguaguaaguaucuuucuuaggggaacaguuucauugcauccuagguacauguaaaugccuucaucagguaguggccagccauguucccagguaccaggaugcucaucuccuugauuuugugaaauaauaacaugacaaccagagagagauuacaacagauucaggcacagugaugcacauccaugaucccagaacucuggagguugaggcaggaaaaucuugcauucuagcccaugugggccacauagcaagacccuauuucagaaaaccaaagcaaaucaagcaaaaacagaacagaagaguggguuguaaggcagauauaaccgcugcuguuacccugcgccaguuauuggccauccuugcccacuacagcagucugggcuaucugugcuucuacugaugucuuagcagugaaaauugagggccguacacugaaaauugcaugaaaauggaagaaauggaaaaucauagaaagguucaucggcaggagcugucgaugaguaccugagucacaacgggaucuucuaugguuuaaacacacagacuguauggauacucuucagauguguauggcugugcgcagcaggauuuugagcccauccuaguccugaaugaauugaagagucuuucacaucucuucccucaacuaccuguuauuaaguaggagcaggaauagauuuaucaaacauacacacacacacacacacacacacacacacacacacacagaguuucuaucagaauccugcucugcauccuuaaauccaguguucuuucaggguaguugcagccuugcuguggcauuucaacuagugcaauuuuguuucuuagggaaacaucuuaauucugaguauuauaagaauauaagcaauguaagguuuuugguuuuuuuuguuuuugucuuuguuuguuuguuuguuuuuguuuucauguuguuggagcaaagaugcacagagccagaggcagguucuuugugguuagagucaaugugguuggagaaguccuuggcacaggagagguuggagccugaggaaggcuguuuccauccauacugucugaugguuuucugaaccuggaccugaaccuggagaagaugggugacuacauggagaguuagggauacaguuagaagggaggaacaggcagaagugaugggaaaguuguucuggaaauugucaggguagauuucuuucuuuacuuggcaucuagcuggguggauguuaagagauaugccugcugcucugauuuuuccgagucuuggcuuuggaguuauuuguagcauccuugguauauuuacuuugcucuucuaggugaggguauauuucccaauuauugaacccacugugcauaaggaaaugaugagcaagccugggugaaaacugguguauuuggccaauggauaaguggcuugcuggcugaugauucaaucaaggauuggaggaggucuuuguagaagaaaugagccugcuuggugguuauaccaucuacucuagaaauaaaaucacuucaaaugguauucacugagggcaucuuucuuguacuaagggcaagccacuguacaugaaagccuuauuuuaaaaauaauuaagcuccuuguauuuauaaauaggccagugguaacauuuucuuuucucuucuuuuccucucucugucucucugucugucuuucugucucucucugucuuucucucugucugucucugucugucugucugucugucugucacugagcccccaggagaacagagaauuuguuagacuuuugggcaugucaagugccuaggacacugaguggucaccaggucuuuuaaaaauaaaaacauaaccaaaauguguuggggauguaguuuaguugcuagagugugugcuuaguauguaucauacacaacauuggguucuagccccagcaccagcuaaaaccagcugugcagcauacaucgucaaucccaguucuucagagguagaggcuggaggaucugaaggucaagguauaaccuggaauaugcaagaaucuuguuuucaaagcuaaaacuacaagaaaaccuugaacaaggauuggauaacacccuuuugguguguucaaagggcucuucugggaaauaggaggaaauagcuucagacuuuaccauuagcuauccuccuuguuagauauuucugagccuaaauuucucuccuguauaauaaagaguaacaauagaauuuccuucuugggccagcagugaaagugcuuucaguccucaguacaguaaaugaguagacagaauugcuguugcuguuggugcuaagagaggcaguaaacuauaaccagcacuccuuaguuuaguggucauguucaauaaaaucacuaaaaacaucaaauuugugaauauuccugggaaucauuccugggacaauaaugagguaguuucccgagagcaucuggucccaaauuuuuuguuaacuaaucaaugcauagcucuguuuuuauguguuucuauuuaaagucaccauaguuuauggauauuauugacuuaugaaugagaaaggcaguggcucagccucagcaccuugccuggaguucaaguaguggggucgccaucacaaaagcacaaacgcacugacagacugugaagggaugcuuaucugcaguggccuaugagcacggaaagagcuaagcagguccuaaucucauaugaccucaguggggaauggguacauugggcugcuuggaucuuuugcuauucuacucaugucuauaccuacaagaaagcagcagauguugauauuugugauuauagauuuuaauuaccgacugaauuugaaaauggggaacccaugaauaaugaaaauugacuuugcuaaaaaugcucuucuugcagcucagaugaaggaacucaguuuuccauuuuguccguuugacugcucuaaacaugcucgucacugccauauugugacuguucucugggcuucucuguucggauaugguaccuuugaccccuuguucuuuguuuaggaaguugggauaugagagucaaguccugggugucaggggaggcagagaagcucugaguucuuuacugaagaguucaggaggaaacagguggagccuucuaaacgcuggugaagauagagcugaaguauccaggcccagcucgcucaggagcuugcagguggggauuuugauuuccuugagcauauucuaguuaucagcugucguuguuguaaacguuagcugaguacuuguuagaggugcugcggauucuucuacuagaaggcagagaggaauugguuucagcugcacaauuuacuaacaacaagaaaacacaaaagccuaccaacagcagccuugucuaguguucuuaaagccagcccuuuuuguggcuggagucuuggguuguaguuugucuugucuuuucuuguauguuuggguacuauaauacuauucaaagugugugugugugugugugugugugugugugugugugugugugugugugugugugguguguacaccuuagucuuggagugaagaagauuaccuguguuauuuucucuuacacuauuuuguguuagaaguugaacuaucaggaacacauaauuugcaucugggugaauuuuaaaugcaucaagccaucugcuacccaacagguauggugugagauguuuaagacacuuuguauauauaauugugccacgagauuggcaagcucccauuuuauagaaaaagaaauggaggcuugccuaucuucuucuucuuuuuuuuuuccuuagcuauguuagugcacuuaaagaugacauccagauucaaaccuaggacugucucaacgugggugcucaccucuuucuccaucacuauuuggagugagugcuggagguguugugguucagagggaggggcaggugugaucaggggugacaacucauuguuuuuggaauggaaagaauacuagguuucugaugaaguaaagaccgaggacucgggguguggcugaacaucugaauccaagguaaauagaucuauguauuaaaggugcucacagcauuccaggauaaaacguccuuuguuuuccaagcugcuucugaagaaggaaggggagauagggugugauugcucccagaaagguagcagaagauagguuguuggcucuuuaaucacucucaagggcauuauggguaaguuguugguuucccccauuacuuaucaaagcuauucuuugggucuugcuucccgaugccuucaacagucuuauagacacaccccagcaucuuguucaccacuagacauguacucccuaacaucuugguguuuuucacugauuucucucccuuccacacccccaccaaacuuguucauugcuuuucuugugugccuucauaaaguuguagccaguguguucccuuuuggacuguuuaucuuugacaugccagaguucuugaaacaucauaauauuguguaaugagccuaacuucugccuugacauguggguguuaagcgcauuagucauugcaaagcauugaguuaaauauuuucaauaaaagguuguaaugaucuaacagagaggaagaagcuguaaaccgcccgguugauggcuuuaauggggagccauguacuuaguguguuuccccaagcaaguuaggauccauagcucacaugcacaaggcuuccuacucugcauagugggagaggagagagauggacaguucaaagggacuuuauugucacacgugaaggaaagcaccaaccguccaaguuuccagagcucuugcuccugaauccuuaucugucacguaucucuaacucccacgggaaauguuaaagccuucugggagacauuaucaauagugacucuugggcugagucuuaagccucauuaaaggcccucagccuuguaauagugaucagccaguauuggagagccaccagggaguucuccacagcacuguggaaagcuagagcugaaugacaaaaacgccugcaccuaucaaguugguuuuaugaagaguuuuaggcagcauuacucacuaugaaacuauguuccuguugcccugguuuaucuccacagacaucucuccauggcagaagguugacuacuugucucgccgugucucugggcaucugaagaugguugagguacauugcuuugguccuuucuggggaguguaucacagccacggaccucuuggaaauauugucuagauuagugguuuuggugauugcuuuguuaggauggugggccgccuuguucguggguuuggagguuuaaaugagaucgugggcuacuccucuuuuuuccuuggcagagaucuucaguuguuuuguuagaaaaccucagagcucuguaccuuuuccuuccuagagaguuugcaaacaagggggguuguuuuuaugucucagcagcguccguccguggcugcuguuaacguagcucagcacuagguguuuucaaagcacaucugaguggaagcauuucacuucuuugaauccuuuucuuuugugguguggcaucuuguacauauugaucacuguuuccaugaucuaauaggcaacugaugauauuuuugggacuggaggauuuguggaggggagaucucuucucgccucucaccuuugcgccuuugccuugcaaguaugaaugaucucuuguccuccuguuuaaugcacgccacauggauuugucuuccccauucccugaaucuauagaugagggagaacacacuuuugaaugggagcccaggagccuguugauguaaagugucuuuuuaccuuuuaagauuaccaucguuagcaccucccuccuuccuggcuggguucccugucauuuuaagcaggcagcaauuacagguuugcuaaagaagcuggcuucugcugccaaggcuccuauuaauuaucacucuaucucuaauuuagccuucucaguguugagagaaggcacauguaagccuucugcuggaggguugcaaugagaucuccauagucaccuucuuucugagccgguuguguagacucuauguucagccaaagggccaggguggcccuggugaguguuuucgucuuucuuccauaaguuguuugguaguucguauuuagcaugguuguggguuuuguuguuguuguuguuguuguuuuuuccuucugauucuggccugaguaagaaucaaauaagccuuuaccuugggaucucagacugauuuccagucuguucuugaaccuaaaaugaagacagcuugaaaacauguaagugauuuucccaccagcugauuccucuacgggugaagagaaaagagaccauggaauugacucgaugccucucuuccagaagguaauauccagauguuaaccagagcauaauaacacauauggugaccagggaguguauccuaguuacugcuucuacuugcgaguguguguguguguguguguguguguguguguguauguguguguguuaggacaucauuauuuaauauuagauuuuuuuucucuugcugcucagaagugacuggaucgcuaauguuuguucagaaacguugaguucacuugcuucagugaccacucuuugaaguuucuagggcucauuugaucaggucuggagugcguacgcuuccuuucccacuuuuucucauguuauuuuuggcacugcugguguuggaagcuggggaagugauucacugcaaagugaauuaauuuuccacguuuucugauacguuccccagucgcccccugguuccucuccccccgccccccccccccagagaugacucugcacuuacacugcugucaucuuugcuggcucagacagaaaugcugaugucacucagauuucuuaaauuacagcugcuaggaauuaacagaaaucguaaaaguauaccacuuccucauuuugcuucuuucuggacuaauuauuguccuucuaaguccuuggggagguuaggaccuuggaagcaaauucugucuaagaguucaaaaggcaacuuucaaguuucuuucucugcuacuccagagauaauguagccccuaggauggagcucuggcaugaccuucaauaaccccagccugguccucacucaggaucuaacagguuggaccauuggacccgucuuuucuccugggugaagcguuucagacaacuucccuuaaguaaguuuccuuauauagaguguuuuugcucaaugucuuuugccagcucuagacuguuuuuggucugagguggaaguucuaauuuguuuacugauguuuucagagccuuugcuccuugaggugugcucucuucugacgcccucacucucuccuuucguuuaccaccagcacacauuuguucuucugucuccacucccaucucuaguagcuaguugcugggcuuuaggcucucauuaccucuuguuugguggcuugagcgauggcuccaagaaccuguccugggaauuccccaggcuuuggagagggcuguguggcugccaccuggagugagcauccaggauggccaugcccuguuuggcucuauugauugaacugagccccauggaagcagaaauagaaggguucagcauuugcacuuuccuguguugagguuuuugcuuauuucguguguuuagaaaaagcauccauuugcaaacugcugacuuacuauuuucucuggaauggaaacuauuuggauuauuucaaugacuuuuagcuaagacuuguuugucuacagaauuaguuuuguuuucuggugucccguuuaaagaaagacuagaauaugccuuuuuuuuuuaacuuuauggaaauaaguguuccuuggugcuugggaauuacgcaaaccaaugcgcauuugaaauaccauguuuacuccacagaaucaaaauagaaacucuaaagugaaaauuacagauauguaaauauuucuaacuugggacauuggcuuccuuugauuuuuauuuuuccucuuguuuaagacaucuucagauuuuagaguauucccuuucacaguucauuuucucacuaauccauuucacucucucucuuuccuuuuagagggguggggugguaagcaagguucaacagcagacuugcagauggaagucauguguacuccuugaguguuugcuaugagcuggugacgggagcuuuucuguuagcuuucaccaaaucguguuaguuuaauuuuaagauaaagagauuuagcuuaggaggaugaaauaguaguugauuauuuuaagaacuauugagcaucaauucaagauucuuaggauaaagcaucuuuguugagccuccgggagucuuuuugcuuugagaucuguauauaguuagggagcauucccucugauaguggcagugauguuugaauugagauuuuggacgucauaagaggaacuauagauuaagcaucaagugaacuguucauuucacuauauuggugaucaugcaugguuuauuuuauccccacaaauagcaccaugguauaccuaguaauuccugagugaauguugaaugcaugcaugcauugggaagccugguuguaggaucagcuguuucauaacuaacugugggacccuggguuagugucuaugaggagucagucucuuuuguccagugaaagggaaggaauagaucagggauggaaugacugggcaaggcacaugcugcucuuugguaggaaaugagaaccucuuucucaccugccugggguccuuuauggcuuccagcuuaugccacuccacuucuuggggaaaugaagccaggcgcucucucagaagccuucuuucuaagguuucuuaugauggaucuuugaccuugcggcuuucuuuguuuguaacaagucagcagcaguuugugacacuugcaggucagcaggcuuugacuuagucaacagcgagggcagcaguauacacuauuggccucuccuuuagauugacuugaacuaucagcauguauauauacagcuuaaucaguaggcacagccaguauuucucuagaggaggaagauaucaagaggugaugagauccacagucucgccuuuuuccuuugaaucccuucugugcauggaacaugugaucauugacagcugcugcauucuggacuguccaggccagggcuaacaugucugcccugaagacacuggaucugucuuccugcaacucacuauggcauaaauaugaugauucgaaaucuguaauuguugcuuugggucuaaaagauggaaaagccugcucuucuggggggccauggcaugugaagaaaagucuccucgcaggagugagccugacuuuaucacugaaaggguauugcccaugaaaugagagaaaaucauucuggguggaagccccacagcgugacucgagcuucgcugagcguggcuggagcuguguagguaagggacaaugcuggacuuuccacuuggaggguccagcuguucucaaccauccuaagguugugaccuuugaauacaguuccucauguucuggugacccccaauuauaaaguuguuucauugcuacuucacuacuguaauuuugcuacuguuaugaauuguaauguaaauaucugauaugcaggauaucugauaugugaccccugugaaagggucccuggaccuccaaagggguugugacccacaggcugaggaccacucuucuagaugaaucuucuuugugagaaaugacaagauauauguggugugccuccaugaagaugggugaugauugcaagagggugaaauccuccauuucaguuugaaggcagugaggccagaagugaggauggcgugcugcuuacuggucauaguuaagcaaccacucauccuuucgucuacugaguccuucaucacauagucaggagccucuucuguacccagcauggggaauagccugugaguaaagcagacaugguuucugcucucuggaagccucuguuccaagaggagaacagucauugagcucuggauggggucaaugaucaacauucuacuaguccgucuugucccgcacucguuucuuuccuuuagauaauuuauaggcugguggcuugcuucaaugacaagaguuggaaggugauguuagguaagcagauaaggcccaugccuugcauugcauaugcuuaugugccugcacagggggccuacaauagagcauuuggugacuccauaggcaaaucuguuccaggaaaaguucuagacauuuccccauacuuuguguggaauggcccuggcauuuuagucugcagucuaagaagaaagucucagaucuuguggaccuugaaggcagcuuugguggcugcuuuccugccuguguuccuuguuguugccagugcuuggcauuuacauggaggcgcaugaaccggccuuggggcaguaagacugacagaucagagaagugaucuacuguaaagagauguuuugguacagacacggcaaucaguuucuccaccaaauaaaagucuuccaagguccccauccaggccagcauugucuauaauacagaguucagacccagcugacugaaugauacggauuccuagcaagguaaagcaucacuacaaggagauguugcagauuuguccagggagucugccucucccaaugcacaugauugguaaaggcagaagccuguugcuguaagagcuguggagucagcucauuugaggucugaaucucagcugcauugguaaguagcugggugagucuagggggaugauuagggcccucuguuccuucacuugucaaauaagguggugguuaagcacguaagcucuauuguucaacuugccuggguuuguaugccugcucuacugcugugugacaaugagcaguguguucucuuaacugucuuaucuguagaaugauaacaaugaagaugauaauaguacaugggauuauaugcauaaggguuuaacacaauaccuggcacuuaauucauucucaguauuccuuacucagccaucuuccuuaaccucauuguguugggcuuucucgaacauccuguaaugaaugcugucugacugguauuuuguuuuaucugaaaauuaguguuuuaugaaauacacuugcuacuaugugcuuuucuuugguguguguguguguguguguguguguguguguguauguuaggaucuuguuauauagcccuaacuagaccggaacucaguauguggacuagucuggccuugaacuuuagacaacuuuugccuccaccucuugaguacauggcugccaugccuggcuuuuguuuuuuuucuuuaacuuaaaacuuaaucguagaauuucugggugagggauauguuugcuguucuacauaguggauauccaauuacauuuuaauuuuuaacagaauuuuuuucaauguaugugacauguauuauuacauacuuaaauuuuaaaauugcuuauuuaaauuuaaauggguagauagccuauauuuuuauuugcuaaaucuggaaaccuaguuuggaacuaaaacuuaacuguguacuuucauuugauauauaugugugugugugugugugugugugugugugugugugugugcauguguauguguauaaauacauuauuuucugucacaauaacauuuauuaugaaaagauuaugguguuuuaauaauauacauaauacuauauauggcauauugcaugaaauuaugaaacguucuggcauaguuuuaaccuuaaggggucagguaaugcccuaccauguagaugcacauuccggagaauccugaagaucucaucaccuuugaaggaaauuaccucauuauucagagucaccuagcuggggaacaaugccauuccuuaggguuggcucgguuuucuaagcagaagaauaaacacauccagugguuagguuaauaucuuggaaugauuucauucuguuuacacccgaagcuaauuuuuugaguggcuuuggccuugaagcuaugagacucguuggugacucucagagaaguugcaucuaagacggagaugcuuugaguucaguguucccagagcauacugugcacaccggagagaugacuguucccaccuucaaauccuuucaugugugauggcucuagagcaagaaaugauacuaacaagagacagaauaaauaaggucauggucuauggcaggucaagccaggucccagaggguugaauguacuguacgcaauaacuaauuguggaaagcccaaguggauuggaaguggauuaaauuaaaaguggcuucuuggaggguacuauuugagagaacuuaaccaaaaaaaugagaauaauuucauuuucagaaauggaauguucuaaguaugaggucagcauuaacaaaugcuuagaagugucuucaguuugaggcaaacauguuacuuaaauguuucaaaaauagauacauaugcacacaguaccccauguuuccugcaaacccccuuuugcaugugacugcugauggugcaggauaccuacacuugaccuaagauucaugaagcaggauagaaucccauguuggguuccuaaguauuuguuguacaguggcugcucucauguaugagauggccagggagacuguuaccuggucacuucauccaacuaaaaugccuuaagugugaugccuaagccucuggguuaaacuggccaggaagaugccacgagaggccacuugugaggcaucacugacuuugaguauuugccuaaauaacuuugaaagccagguuacuucauuuccuguugagguggcaguuguuuaguagacuuggucuaagucacaguuaauaggcuuaaugguuuugaaugguaccaaauaacucuccaucagggugccauuuguaaccagggaggacuccccacauggaguacagcacacacacagcugauugagagggccugucaccaucuuagacuucccugcagaaaccaagaacccugaaagaaagcauuaaaauuauaguccacgcuaaaacacagcuaauaacucuugcuacuuaaaagaacagcaacaccaggcacaacaaaacaaaccauuccaugugaaguuaauaccauuuaaaaaugacuugucuuuagaacuuauugggacugauccuacuccuuuagcaaaagaauuaaauaaaguguggcaggguguccuuguugguuagauguguggcgaacugguuggguagccugaucucugugucagcagggcuucugagauggcuggaagcagacauggagaacugugccauuuuucaagugaugugcguuugauuagaaagcucuaugcuagaaucgaaauuagcuaggcauuuggaggcucagguauuuauuuuugucaauugguauuggcaugcuugucucaaguccaggcagguuauuugugguagauguuguggcuauuucaaguacuggugugauaggauggagccuggauccaaaccuuuauuggcuucuuaaacaugaaagaacauaccugcuuauguaaguuugggccuggcugaauguuauuauuuuuuuccccuggauagcagggccaaauacuagguaauuuaaauaucuacucuugguucuuacugcuuuauuuuuuggccaugcuuaauaucuuccuuuuuauaucugucauuaaguuauaauugaagcuucauguuuuauauuuacacugaugcauggaaguggaacuaugccagccauucagacuuaauggcaaauguuggcuugugccaggaaguuuuugaaaucuguccucuuuuucaaggauguccagugcagucuggucuaagcaguucaccucuccucuucccuguucaggcugugacuguacagggaagcuuccaugucugugcauggaagaacaucucacuugugaaagaaguacaucagcuugcuagcuuccucucccaguaguuugcuugacaagucuucuugucacuccauccuuaguucaccgacugucgugcaggguuucacugagugccaguuugggaguagcuguguaaugaugcuaggugacacccaugccacaagccgugucccaagggcugucacacacuaucagacaauuuacagcacuugaauucucuggcucugggccaaguuuuaacucuauccaucaauccauggaaccagcugucagagucuuacaucgaggauuucccacgugccagucauuuuuuuuuuuuuuuuuuuuuuggugucaagaauacagugggaugccaaccgguggaacguuuguacccaugaaguuaucugcuguugugugugugcgugugugugugugucaguguguguguguguguauauauauauauauauauauauauauacauauauauauauauauauauaauaugcuaaauggucuuaaauauuugggagaaagauuuaucauuuaaaacugaguggacauggaaagacuugauaagaaaaugcaacugaagaaaggcuucaagaagauuggaaugggucauggaggcaucgaguggaaaaguccagcagacagcaagcagggguaagaacauggucccuaaacagaugugacugauuccgcaggaacgcugugaccaugcgaugggcugagcagagugaaaaguguuggaaauacagaagaugggcagagcuaguuagaggagaaaugugaucuggccagagguugauccauagugcugguuaagucucaggauuuuauuuacugugaauggaaagccaauguaagccuguggacuaacaggguuguuaauauagauguggucuggugugauggggcacagugguauaagaauuuggagaucaggggccaucaagauggcucaguggguagaagcacuugccaccaaguuuguccacccuagauugguccucaagacucaaugugguggaaggcgagcagcagcucccacagcugugcucacaugcuuuguccccagcagaggcaaguguacucagcauucugagcguugauguuucucuucuugaagcacagugcucauuuuucacgaccuuccagcuaugcugggucagcauccucaucccaauuucaggcugcugaaucuuuuauacacacggcugauugcauuuuacuuuacgcaugcggagcuggggcgcuaauguguaaaugaucuuauugcaccuucuuucuaauuuucgaaaaauauuucuauaaacaucuuacauccaaaaccuugcaaauuaugaaauaguuuuauauguggauguuaaagcuugcuugcagaugaaguuuguggggaaucacagauuuuaaccauuaucuauaaccuuaauggugcuuuaugggacacagaagauagauuuaaaguuuuguguuuuacacugagcugucuaucaccugggacauaguaauaagcaagcaaagguccucagaagcugaguaggagaaggagauggucugguuuaaggcagaaccccacucacaucaggagagaggaaaggaagguguggcuuaguuggaggccugugagauccuuagccauaguugguguucaggaacaucuuuccccuaguauucauuaaguuguuugcaacacccacugagccccagugccacccaggguaagaggugccaggaccuggcagacucucuucuguagcccugagcaguuuggcuccuccccaaacuggcaucaugcuguuuagcacaucaagggccuguaauuaacccucuagaaggaguguaggggccaucuuuuauuacucuagaauauccuuggggaaucuugguccucucccaucucucagaacauuucuucugcuuucuuugcuguucuacugucccuucuggauggugccaagcuggcauuguggcuggucaguucacuaguaccauauggagaaguccuuccuucuuuuugccaugucuucaggccucagugugaacugucaggguucuguggagcccagucaugucuuccaagguuagacucaacacauuucuccucuucugugaaucgacguuuuuccuugggaagccuauaguuccuagagucucuaagcccaggcuucuggaacagguuucuaagaggaaagagccugcucucccagacuggccuuuuggcagaguccuggcugguacaaaggagugaagugcggaugagaaagagugaucauggauacagggcugcgacucucaaaaggaugagcccaggucucugccugggugggagcugcccuguggugaugcucaggaggcgccuacuucuauuugcugguacuggcacaagugggcaggaagcugagggcaggaaagugaggggccucugaucuaguuggaucacacaccggaguccuugucugcuaccccacagcuuugcucuauuucuccuugaaacuucaggccuuggcauuccucuuccugccaucuccaacaccugcccaucauucaucuauauuacccucaguguaaagguugcuucuucacuuccuuggucccucgccuaacuugggcugccauaauccuccuugauggguccuggaguuuuuauuucucucuauguuccucuauauucaaggucugguuucuaccuccaugaggccagaacucauagcuauuucguuugccacuguauuuccagagguuagaccaggaaugaacacagaugggcuuuguagaaauacuuguugguuaaauuagucauuucuaaaaacaggugaucaggugguagaaaggcaaacuucauguuuucucuuacuuauuuacaugaaaugucugugccuagcuagguuagauuaacaacuguuaccauuuugggguacuauccaaggauauaggugaugugauuucugucccuuguaugacgcagucugugacuuuuaggcauuuuuauuaagauuaucuuggcacaaaccagaacuuagugaaucauacaaaucagcauucuuuuauuggugugggcuugacaugcaaggcugugauuuaucaauuuauuuaacuauaguuguguuucugcuccauccuucuguuuccaaaagugaguuuuagugcuguuuggguugccauucuacuuaacuaaaaaggaauagagaaaacauugcuuguccuuaauggacuuuauagaggguuucuuuggggcaggggcaaaguguuuguuuugacuuguugauugaaacacuuaagaggguggagauagaaaacuaaauggguauuucuccagaauagaaaaaaaaacaaacaaacagaaaugggauuuuucacuguauaaaaaauaccagcaguggacuucaucuuugagacuuaaugccucaaguauugauggaaacaguugguguggcuggcacacagaggaagcuuccauuguuuuacaguguauggaggucuacuggauccuagaagaucagcucaaggggauauacuaaugucacaaccuaaaacacauaaagugaacacauauaaaaagcuggaaaaucugauguguacuguuuccuagucauucaugcuuuuggggaaaaaaugaggaagcaaggggucagagugaaacccagguguugcuauuuuauauuuucuugggugacacuuguuaccuugguuccucaguucacuucuuugaggcucagaacucucauccauaaaguggaauggagauaaaaacaccaucuaccuucagagcugggaugaagauucauuaguuaaugacugugaacagcacaugcucucucgaugcuauuauuguguguguguguguguguguguguguguguauggggaugguacacucaauauggguaguggguaguugaguaauggacuugagaggagccucuguggcuuacuggcuuggcaaccuuuuguuagucacugccuguaccacguaugguuuccccguguagaguaguaagaacauagcuacauaugcuuuuccugcagaucaacugaauuagaauuugucaagugcccacaguagcuccugguccaugguaaaugcugugcaaacauuuucauuaugauggagaggccugagugugauuccaucaucacacugcagccaggaagaaguggcuuagcaucgaugaguuucauuuuagaauguagggugauugugaaaagccuccugagaaaucggugaugcaaggugugugccagauguuuagccagggguuaggccauggaauacucuguauaggcauuccucuuccccugucaugggagagcugaccaaguacguaagauaggaggagguuauuuggguuggugguuuguaggggcccaguucaucauggaaaggaagcugugguagcaggagccugagcaucuguagugaggaagcagagagaggaggaugcuggugguuucccugucccugccuuuauucauccugagaccccagcauaugggauagugcuguccacuuucaggauggguuauugcuccuccaguaaaccuggaauugcccuugcagaaaagucagagguguaucucuuagaugacucugaaucccaucagguugacaaugaauuaacccucucauuaaguaagucaugagugugucuaagacuuuucuuauaauugcuccuacuauugcuauuuuaguuuccauugcuaccauuaccaugcuguauacagcauuacauuucaagauagagcccccccaaguaugcugaagugaauaugauaaagaggacauuaggauugaguuuugcuucuuccaauaacuagugggauagucacccaaacaaacccuuuagauacacugaaaaguaucuaguggaagacugauuauaaucaaguauguaugauuuuacaagucacaaaagaucaaaggaucaauguuaaguauagagcuaucuguucauggaaaaugauauaagaaauaaugggaaaaauuccaaaaggagcaauaagaagugaacauauacuucaagucaagucuguauguauuucguauguucacuggggcuagacuuauaaggacauacauuaaauuaccaauguuaaauccuaucuguggcugauagccgugcuucuucagaguggauaaguaacggguccagucuugucagcauuuuccauucuagucauuugagucauuguuacugccacaacuauauguagaccuuuaugcuguuuugcaauaugucuuuuuuuuuuuuugagacaggguuucucuguguagcccuggcuauccuggaacucauuuuguagaccaggcuggccucggacucagaaaucugccugccucugccucccgagugcugggauuaaaggcaugcgccaccaugcccagcucuugcaauaugucuuuagguuaagcuuccccuuucagaagagaagagaagagaagagaagagaagagaagagaagagaagagaagagaagagaagagaagagaagagaagagaagagagcgcagacuauagagugaugaagcaugauugagaaauguauaguuuuggcuguugcaguguugcucaguuugugggacacaaccccuuugggggucaaaugacucauagcgaucucuuaauauauaucugcauguaagauguuuacauuauaauuuauaacaguagcaaaauuauggaguaguaauugaaauaaguuggugauuggggggucaccacaacaugaugaucuuaaggggucucagcauuaggaagguugagagccacuggacuagcauuugacugggagcugccucugcuuuagugaaagguggaagacuugcauccagccguugaaugugcaaauaaaugcaaggguaugaagcucugaacacuagauaccuuaguugcaaauauugaagggccaugaaguuccuaaauuauguguccuagagguacaaggacaaccaaaaauauauaagagggcuggagagacagcucgaugguuaagagcaccggcugcucuucuagaggaccaagguucaguucugagcaccacauggugcagguaaccacuaucuguguaacuuuaguuccagggcauccaauacccucuucuggcucugugggcaccaagcacacauguguuacacagauauacauuuggccaaaacaaaaacccauauacaucagauaaaacaauuauaucccuucuuuauuuuaacuugagaacuuucuuuaggcauaugaagacaucuuuagagucugagauuguuugagagacuagaaccuagaggaaagauaaacacagguuuauugagauuggagccccaaauuggagugcuuuuaaaguuuugguaggagugauggccuuuguuccaaggcuaagauggagacacaggaaagauuuaaguagggaauauucauguuucugugacaguacccaggagaccuguugcaggucguagugacagaaccagccaggggcagugcaagcaggggacuuccaguggccagagagauggagaaguggguguaagggagagagaccaggaagacagggucauagcugggaugauuggcugaacaugcacugguaagauggggggaggaaaggaugcaguuagguuucucaccuggccaaguggguagaacaauggagcuguucauggugauggguguugggagaggcaggcugaggaggguggacauucuuugaacauguaggcgauggaacaguuguuaccggggcagcuauaagagaagaccugccuggggcagauuauguauauuaaucuggguuuugucuuuaucugugacauguaauaagcaauuaacagcuguguauuccaaaaaauggagcucagcuuucuauguacaauaagcccaggggucaacgaucagugcaguuuggugacucuaccauggcaggaccgguguagauuuuuuuucccuuggcuuuuggcuaauguuugucaccuggugaugggaaugugacaucccauccacuuuaagaagagggaaaaauauaagugacauuagcagccuggaaaccucacuuuucugaaccaccuccagaaggcaucuccugugucugucagggcucauaccuccauggucaucuugguaucuuggguaaacuauggucuuuagcaguguagagaaaacgaggcuggugcaugcaguuaguuguuuuugcgucagucagguuuuggucaagcaauggagcgaugugugauuuuugagaauuuagaugagauggagggauguguagcuucugagaacuuagaacuuaaaucaucugggugagcaguuucagugaacgcauguguucucaacucugcuguaaaucccaggcuacagcuuucccuuaauguguaagugaagaaaauuguauagcguuugacugggcuuuucuuagagcccuucaaacacacguaacucugaauugucuuugcaaacauuaaaauacagcuuuucucauccugauaauaaucuugaccuacaaaagacaaccucuuuccuuaaauauauucucaaaucuuccuuauucuucagccuucagcagaccuaaguccagagcaaauguggaaaauuccacugcguguucaccaagcacuaugcaagucaaagcaggggacacacgaugggaaaugucacacccucgacuuuugucccuaugaagaauacaauuauucugugcucaaaaguagagaaaaauguguguuuauuuguucuggagguaguauuauuuaauauuauauuaguauuauaagaugcaaauauuuguucccuauuccacuucaauucaagacagucuuuaucagcuaauagacccagaauucugaaaguaaugauuuuagguaaccgugguucugaagauaaauaauguccaguuccagaagaauagcagaaagcgcagaguuagacaagauccugccacuuauacugggugaccuuggagauguccugcaacaucucagaacagcuugcugucuuuccugaaucuugacugagccagagauggcuguacaguaggcacagcagcaucacaucuguaucuagcggcaccuuggaggcaggcugugugggacacacucagaguguaagugaaaugaggaaugguuaaugcaugcugugagauauuguuggggagggguggaaacugccugcuggcugccagaggggaauuccagggcaacugaagacgcccccaggaugcaggugcacaacgugucccauguguucaaggauuuguuuucaauucagaaaggcuugacaggaugucugucugaguugggucaguggugaggaacuuuaagaagguuuauaugaauuuaacuuugaagaaaaaugaaacucaugagucugagauugcagacauuuaacaauuccauagauacuuugagauaaguagauuuauauauaguugcaaaaaaaagcugggugugguggcacacaacuuuaauaccagcacucaggaaagagaggcagaggcaggcagaucucugugaguucaaggccauacuagaguauauagcaaguucuaggccagcaagaccuguguccuaguuagggcugcuguugcuaugaugaaacuccaugaccaaaagcaugccggggaggaaaggguuuauuugguuuacacuucuguuucauagucaguugguucucaaccuuccuaaugcugugacucuuuaauacuguuucuuguuuaaccacaaaucaccagauucuucacuauaaauuuauuucauugcuaugucauaacuguaauuuugcuacuguuauugcaauguaaauaucuuauaugaaggauaucuguuaugcgaucacgguaggggucaugacccacagguugagaaucaccacauagucaaaaggaagucaaggcaggaauguaaacaaggcuggaaucuggaggcaggagcugaugcagaggccauggaggagugcugcuucugugcuugcuuuccauagcuggcucagccugcuuucuuauagaucgaggaccaucagcccaggaauagcaccacccacacugggcugggcucuuucccaucaaucaguaauaauaaaaaaaaauaacccacagcaagaucuuauggagacauauucucaauugagacucuauuucucagaugacucugacuugugucaaguugacauaaaacgagccagcacacccugucucaaaaauaaaaauguugggacauccacacgcccucccaugguaacauugagugucucacaacuuggaaagugagcuggcgacuguugagggaagugaugacugugcuuugucaauuucuacgcugauggcuguucugggagcuacgccugggauggaauggaagccacaggauagcauggaggcagggauguccuucugaggauguugcagugguccaagauggguggagacaguagugauggcaguauuugugggaguagccacaugaucugcuagaacccuacacacgcugagagcagcugguugccugucucauuggaggcuuucucaguucacauggaagcuaucacaauuuauuuacucuagggacuugugcaucggcagcccuagaucucagauauucagguuacuauagcauagggcuuugcaggcaugucagagaauggcagccccugccaaguucagggcauaacaugaguagccguucaugaagacccagaccuggaagguuaucagucagcuguaauaaucccuguuuauggaccugauuuuuaaaaagaacacacgagcaauuuuuaauuacuucuuugaggccuagccgguagcaucgccagcucuuaauguuuuaaugugugaguuaaucaguagaugccaaggccaaauuacauucacacccacacacuugacccucauacuagaaaaaugguggcuggcuuuuauugagugcuuauuauguuaggcacccugugugcauuaucuaguuuuaucuccacaacaacuccauuagugacuguuauucuuccaccaaacaaaugagagcaccgagguuaacagggacuguguacucaagugacaaaccaugacucgaacccaggacuuccugauuucuaaaucugaacaugugccaugaauuuuuaggguauguuagcacaucaacguauucacugugcaaaguuuauuugcuuguaggccagcuauuccuuguuucuauaucauuccucuaucaaguacucucagucugcuuuuauuucucaguuaccuuugacccuuugccaaguagccacggauccuuucauugccucgacacagagccaaacaucacuugucugauauaugcuuugggggagagagaagaaacuauugguccuucuuuccugagugacagugagaauauuccugucccacaggagucugacauucacuuaaauucaugagugucuucucaggugcaagaagaauuucgcuggcuuggaagcagagacccaucuuccccucaugcaucacaggaagcucagauacagaaggaagcugggugcuuuuugccuuucuuaccaauccuucugcauuccccacaguaugaaagagacagucugcuggcaaccucguuauuauuggcuggcggauuuuguuggguggguagagaggaaagugagguccuuugguuacuucaguugcuuauucaaaaaugaauacacauacaauaucauguauauguacacauauaaugugcauacacauguauauaccaacaugucuaucaguauguguauuauauauacaugucuauauaccagugugcauguggauaugugucacuguccugcguuaaaugugaagucugguuuuacuguuuuuaguaccacagagaguggcuaaggucccauuuacuugccuaaggaauaugaaaugcuuuguuuuuacuuauuauuuauauaguuaguuuuuugagacaggugggcucuuauagcucuggcucgccccaaacuugcacugguggcugaggaaggccuugaacuucugacccuccugccuugaguuccccaaaugcugagauuacaggccugugccaccacgcccagugggacuacagaugcucuauuccacucacuuacaaaguacuaauuuuaaaugauccauagaauucauuuuguagauccaaaugcaguguuguccaaaguguaguuugagggccaccuaugucaaaacaaccugcggugcagagacuauucugaauuccugggucaagacucaagcucuccugaccugaagucuguaggaagcuucuggcucuccaguuguuuuuuuguaagucuucuccagcagcguuggagaguuugauguaccagagugagcauaaagauggacuuuauguuuguccauuugguuuucuuuucuuccuccuaauuucacucuacugccuucuuuccuuuucccuuccucacacacaucagaggaagugauggcauagguuuaucuagaggcuucuguuuguuggaguugaugaaaggcuuuuguuaauuuacuagaaucacauuucaguucuguccuuugcuuuguggucuguacaaaaggggccauuggguagaaguuugucucccccaccuccucuuuguuucucuuccuucucuuuauucguacccacucuucucagaucugugggaaggaacaacgugcuguuugucuuucccgaugaacccugccuugcuuggcuuucggguaucgucuccaaggccugacaguuugcuuguccucuucgauaucagagaauucacggcaaacauuucucugucuacagagagagcuuucagucagaggcaucagagaaguguuuugauugagacguguuuugauucuuuagugucucagagucacaaagaucccagggggcucuguaagugcgagguugugagcugaaaggauccuggugaagaaguccagcaugcauguaggcacacuggagacagcuccugauucaggggacugcacaugaagcugcuccccauuucuauccguggggcucacuaguuggguuccuaggaggaguucuaggugauuugggagucuaaaggcgcguggauccaguuucacagaggcacuuucuuuguuuuggggacgccugcugucuguuuaggcugggcuuggcgguuuccuuacuugcacagagcaugcgucuuccugucuugccucgucugugaaagcuucauguuggcugggaaccuuuggcuguggagcuguuaguagaguagauuucagguuguuuagcagugaaggccuggaacauuccucaggagggcugagcagggcaggcugaguggagcugugacucacagcgugcuggggcagucguguuccuggaauaauaacagugacagcggcaguggcagcagccacagaaacccuuauuggcagcagccagcauuuauggaagcuuccagugugccaggcccugugcuaaaugcccuccccacauuaucucauuuaaaucggaccuagagcaucuuuuaugucagccuuguagaugauaaucucaaagucacgugacuacuaggaagaaggacuggggcaugaacccugaucucuaggauguuagaauucaugcauuuagcaauacuaucacauucuguuuaccaaaaagggugugguggggacaggccagugagauggcucaguaggauagauaugcugccacugagccuggcaaccugaguucauuucccaaagacucacauaguggaugcagagaacuuauucccacaagcuguccuuugaccuccacacacauauguggcaugcaugcauaccuuccuauaaauguaauaaaaguuauguuaaaaaaaagauacuuucuguuucugacuuuuuccuucuuucuuaaauuacaucacaaacaguuuccacuuuguaauuuaagcucuagugacaggaaaaaaguuuuuccccuacuuuuuuaugaguuaaggacuguaagugauaggaaaaaaaauacauuuugggaaacccaggcuugcaaacuaggcuaaaccuuuugcuugauaccauguccaucaugaugcacugucaaaacggagaccaucuuugcuaagcaagugacugaagagauggguaguccauaaggagcuuucugaccaagcuuagaaacccaaguuuaacccacagaacccaugugaaaaugccaggcaugguaaugaugugcauacacaauaccaacaucacagagguggcgacacaugcgauccuugcagguccuggugagcuucaagaucccagugagagaccagguucaauaaagcaaguggacagaccccagaagauaacacucaaggcugacugcuagcuuccucaugccuguagaaccugacauuucacaccagaaaaugaauacugguugggcaagggaaaagaaaaaaaaaaacagagagacauguuuacaaguccagagacauuucuacuuuccuacauuagacagagugucagaauacgggucaguguuccacuguguagugauuagugccguggauauuugaugagaacugaaguucucuaaucauguaagugugggaagcugagaccaaguguguaaacaccauagcacccagcccugucugaaugucucuggugucuaccugaaguguuuguguuuacuaacuggaugaagucaguguugucugcauucccaagguuacaugcugucgugggugagguggaaugcuaaccaaggcugggguguuuuggguuguguuuguuuuucaaguuaagguuuuuuuguagcccuuggcuguccuggaauucacucuguagaccaggcuggucucuaacucagacagauuugccugccucugcauccugagugcugggauuaaaggcauacacuaccucugcccagccaaggcuggaauguuaaccaaagcuaggauguuaaccaaugcugggauguuaaccaaugcugggaugcuaaggcugggauacuaacuagggcugggauguuaacuaaggcugggauguuaaccacacuuaaccagggcauugguaguccagagcuuguacuccguagcaaacauacucauauauguuacauauauacauaccagaccauuaaagcccuucauuauguuugcggcuucucaucuagccuucuauacaauuacaauguaaaguucugaaauuucagugacuaacaaauuuggguauuaucuuaggguuuuacugcugugaacagacaccauaaccaagacaacucuuauaaggacaacauuuaauuggggcuggcuuacaaguucagagguucaguucauuaucaucaagaugggagcauuuagucaggcaugguacaggcagagcugagaguucuauaucuucaucugaaggcuacuaguggaagacuggcuuccaggcagcuagaaugagggucuuaaagcccacacccacaaugacacaccuauuccaacagggucacaccuaauagugccacucccugggucugagcauauacgaaccaucacagguaucuuugugucucugauuuguuuaacuguagacucaguguuuucagaaggggggaggggggaacuugauggaggagaucaaccaguacacucagaaaugugaauaaagacugucuuauucugauguugaucuuuaccaaacauagagcaugaguaauuuucugaguagaaaagaauaggauaaggaaucccuaagaacgcagcuuggucagcauuugucccuugucugcucaucuuagucacuggcauggcuuuaccuugcugucucuugaugcauguguaccuguuucuaaugcuuuaugggcuguugacauaaaggaauauaaagcucuuuggguuccuuucaaguaauaaguuacuggcucuuacuucucucuugcucuugcucuucccuuccuguucucuccccauucccuugccccccgcccccccaugcucauggccagccucuucuccucuuccucuuccucuuccucuuccucuuccucuuccucuuccucuuccucuuccucuuccucuuccucuuccucuuccucuuccucuuccuccuccuccuccuccuccuccucuuccuccuccuccuccuccuccuccuccuccuccuccuccuccuccuucuucuucuucuucuucucucucucucucucucucucucucucucucucucucugccuuucucugccucuacuacccuugacuccccuccccaugcccugaauaaacucuauucuauacuaaagaaaaaaaaaguaaaaaacaaaaccaaaaaacucacuuugaauguuucucauauguaugaucuuaucccuuugaaguucaagcuuuuggggccaacgacucaagguacgccuuccggagaaguaaguguuauuuccaaguuuuguuuuagaguuagagcuuccucccuccguucaaaagcaauucuguuguaagggacagaaucagucagaaacagcagagcgggcaugguaaugggcgugguagcucacgcaugugcuuacuccauccagucccaaggaacugaguuccuauccacacuuugccuccugucaagaugucuacucaaaacuucuaggacuccuuauuucuucagagggcuaaaggagagggagggagagaacauagagagagggagggugauagaguagagggaggcucgagugcacacacacacacacacacacacagagagagagagagagagagagagagagagagagagagagagagagagaagugaguuucuaaaagacauaucagagcagcaaagaagaaugucgcacuguucucugcagucagauaugaguuuuguucucagcugucagcugcuuucucugguggaagaagagaugcaugccuuggaguacagaccgggcagguccucggauggagugagcgucaccuaaagaggaggaaguuagaagaaagcaggguguuugcaagcucaggugauguggguacaguucuccacagcugaggucagggaacaggugaccugguagguuucccucauggcacugguuacuuaggaaguuugcccuuugguaaacaaaagcccagaucaagauuugaaagcugacaggucuaacagaaguccguucucuucaugcuagcuucuuacaaagucuccgugguuugaccuuugaacuuauacaguacuacaaugggugugcuucugaccgguggcucuccccuccaugugcuuucugugcuggacaaugcaagcuuucacagagucaguguaaaguacccugaguagccuccuuuagucuuucugagcucaggaaugcuccugguaucuggcauuggccuuccuaacguuucauuuuauucuuuaaaaauggcacuacugauaaaauugaagucaugacuauugaaaggcaccaguaaccagauagugguccaaguuuccagcuguuggcugugcucuaggcuagcacuauucucagugcucuaguuaagugcugugcucaguacuacaaguaagugcugugcuuagugcucuagguaagugcugugcucagugcucugggcaagcauugugcuuauuccuccauaaggaguggcacuauaguguuacucacacauaucacauuugcccuuugaagauuuggagaaugggggaugcaauugucucuauuuugaauaugagaaaacucauguuaaacaaggcaugcaagguuguguacacaaaaacuggcagagccaaagcuuaaacccagcuuucaauauuaaaaaaauuguuuacauauugaugaugaugauauguuuauguguauguagaggggugcauguaugccccagcaaaaguaugagagucagaggacaacucuggggagcuggcucucuccuuccacccacaugggguucaagugaccaagcucaagucuucaggcuugcggcaagcucuuuuaugcacugagcccugaacccaacuuuguuugacucuaggaucugugcccuuaaccucagcucccucgccuugcaaagcugugaugcucugagcgucuucaccuaacgcugagucaggaagaacucugggcucugcuggugaaguauggugcuccugccucugcguucuagucguguggaugauggaaagaggacaguuaccagcuuggaccuggaaacacccgacucugagauagcgcagccuaaaacuauauuugacacaagacacagaaaacauuugagaaaugaaguacaaaguuggagggcacacccacccacaugcauuauaaaccucaauaaaucaaagcuguauggagcugauguaaagacauaggcauaucaaagaaucugaagagagaggccaggagccaagugcuccuucacaucggugcccagagcacucaauaaagagaggaccucuuauuuagugaguagggaugaggaaauguguacccacacaugaaagacugaagcuagauucuuaccuuauaccauacacaaaaguuuuaaggcuccgaaugauaagaaaugaggaagaaaaaauuaaggagaacucuaaaugauguugggguugccagugacuuccuggaaaauguauucauaaagagcacaguucacuaagagcaaaggaacaacagaaaaugacaggaaauuuauacaagucauguacuggaugaagagcuaagaucaagauucuacaaagagccauagaggcuggguagagagcucacuagaugguguuugcuggguaagcaugguggccaucugcaauagcgguaccuagaaguagacacaaagagugggucuuagcaucaagcuggcuacugagaugagcgaaaguucuagacuccagugagagacccugcuucaauauaagacgggaagcaauuaaggaagacuccagcaucaacuuuuugggcuccacacauaugcuuucauucauauauauauauauauauauauccauacaugcauauucacaugcauucacacaagcaaaacagagaaaagggcacauacaacuugacaacaguacaaugaaacacaauaauacuaccaaaauuagacaaagggcuagaucauccagacaugcucuagaaccagccacaggccagugaaguaauugaauaucauuaguccuucgagaaaugcaagucaaagccauggugauaugcuaccuugugucuaucaggguaauuaccaugucugcagaaaggagaagccauugguggugcuuuggagaaguugggacccugugcacugcuaauggauuauucgauggagcagcugccguagaaaacaguaucaagauuccuaaagacuaaaaauagaguugccccaugauccagcaacuucaguucugagcacaaauccaagcaaauugaagcuggcaagucagagagauuuaacacccauuuucuugaucacaauagccagcaggcagaggcaaccaacagaugaggaaacuauguucuauccacugugggauauuagucagucuuuaaaaagauuggaaauccugauauguacuauaguguggaugaaucuugaggccauuaggcugaugaaauaagcugaucaugaaagacagauaccguaugacuccauuuauuguuuuucugucuacugaaguugaugaguggaugucauuuaacuuugcaagauggaaggaaaggugcuagaaccacuauugcauuauggaucuauuuaacauuggugaucugcgguuuucaaauggccaagagugggauggagggagaugggccagugguuaaaaguacuugcuuugaaggcaugaggaucagaguucagauccacaucacccacauaaaaaguccagcauggcuaggugugcuugugaucugagcacugcaugggauagagauaagugcaucagccagcucucuggacucacucuagguuuagugagaaaccugucucaagagaguaauguggaggaauagagcaggauaucuuacuuuccuuaaccuuugcacacucaugaguuuaugcaccuaugaaaacacuugcauauaaacuguauacguaacacacacacacacacacagcaaaacaaagaaaaaugugguuaagauaguaaaauuuccuguugccugcuuucuuuaaaaucucaacuuuaguuaauucucuuuguuuccugguacuaacucaagugccuuauuuggaaauugggacaucuuuggaauuauguacccugagcucacauacugaacauaguugacagacacacauguucauaugcaccuucagucugcuacugacagcauaugauggcauguaguguuaaaagguggauacgcaacucagagcacaguucucacuggcuagcuucuuguccuggaauccauucucaugugcaaaccucaggaaguuuuaggauuaacuuucuugaagggucuuguuauaacauuuguguauuucuguacuucccucauauuacuugaaugccacccuccccccuccuccaucuccccauuguucuccuugcuuccacccaaauaauauccuucaucugcuuucugugucauaugcuuaugacacauacguguuugaggaagcagcugucaguuuaucuuccauccuuccauucuugguucucuguauuuauguguuugaaauaucaagcuuuuucaucgccaaugccccccccccccccccggccagguccucugccguaagcucugcaccucgcacuuucuagagucaccuuuuagagccuuucaguguucugucugucuuaggucugacuauguugugaccacagaucuuuauaggaacacagccugacacucccuguucccuuugccaucuggcaggcaacagauucuguccugugagucauacucuaaauguagacgcuuuaacuuucagaugugaauggguuuggugggucucaagucagcagcaaagaaggggaaaggcugugacuggcaccugcccuugcagucccaggagaggacggugaaauccagcuuucagagcagucauucaacucuggugugaaagaagguuccagagccacugaagggcuccccaagccacucaucaucuccucgcagcauugugggugggguucucugagauuguaauucagaaagauaaauauaucuuccuaguuucuuccacuggcgcuggauuaauaguacgcuaauauaucgcuauuuuguaagcaagaaaaacauucauguuuugucagucucucacgugcaaaccaucuaaaccuaauucuauauaguaaagaacccagggacccaagggugaccucuucaagggaaguugagaaugguuaugcaacaaacuauaaaggucuuggcuaggggaugggagaggcuuuuuagugcagcacuucucagccuguggggugugaccccuuucgaggguugaaugacccuuucacaggaguccuguaucagauauuuacaguaugacuuagaacaguagcaaaauugcaguuaugaaguagcaacaaaauaauuuuaugguuuggggucacuacaacaugagaaauuguauuaagggguuggacauuuggagacucaguccccaguugguggcacuguugggggagguaugacgguguagccuuuuggaggaaguguguuacuagggaguggccacgagagcagaaagccucgaucuaccgcccagcucguucccucugcuuugugcuugccguuugagaugugaacacucggaauccugcuccauucuccauacaugccugauuauggacucuagcccucuggaaccauaacuuuucguuccaaauaaacucuucauuccaaaaguugucuuugucaugguguuuuaucacagcaacaguagaguaacauggugauuaagaacacuugcuuugcuagccugaggaccugaguuaaaaauccccuguaauaaccuaaaucccacaauauaacccagugcucuggcauugaauauaugaggacuaguauggcuugcuggcugacaguguaguucuauguucaaagggagucccuuucucaaaggaauaagacagaccaugauagaacagaacaccugacacuuuccuuuggcuuccacaugcaugggcucauguguacuuguacacaugugcuaagaagcccacacaugcuaagauauacacaaacaugagagagagagagagagagagagagagagagagagagagagagagugugugugugugugugugugugugucuuggcuguuugaaaguuuaaacuggcucaaguuuucagaucuuuaauguuguaaaccugauuacucuauuauccuaagguaggcuucuuauauccagaguauguaggaaacauagcaacgguguauuaaucacagcuacacccaucacgguguucaaguguguguauaacugugugugcauuguuagagaugccuguguguugcuuuauuugugccuuaggaccugggaagcauggcuuaaugcuuugaguaacagucagcagaccuggaggaggccuucauuucuugggaucagggaacagagagaacguucuggaaaugagcuuuggcuaaggaggaucuugugugcugagaggcgaucuucaaggggagacaggucugugcgguccagaguagauuuuuaauucagagcaggcagugucucuguguugguauggcuacccucgaucccaccaaccuccagugcagaacugucaaaugagcaguggaagaagaugaaagaaaggcagcaaggccaaagcaggccugcccagccaugcuguucuguggcgggaccugaccgccagccacuggccagauguuuggaggcuguuccugguuucauuucccugcuuuccugcacuaacuugaccaacagcagcacuggcuggugaaaacaggaacaacacaaugcuuuccugcacacuuucauaugcugccuuccccucuuccugugaccucucuccccuuccuaagcccaaguuuacuuucuaggguuaucuucuuuccuucucuucugagauccuguucuuuuaaagaaaucggccuugauaguuugcuuuguaccagcagugccuccccaugugaacaccacagccugcgagaagcucacgcaacuuggcuuuuagggaugugugcucaggcuguaacagugaugcucuguauuuuggagcugucucaccauagacuucccagcucuuuggcucuuacaaauuuuucacccuuucuuccaugauguccccucagcuuuaaauacaggaauacaauacaaaguggucagccaugaggugauaugcaaacaagcaacaccaaauggauucgauucaguagauuguaguuauaucuaugcuuauacauuaguauguguguauauguauguguguguauguauauauauauauuauugauaucuauauaucaauaucaauauauauauauuuagccaaggcucgggaagaugugauguaauuacauuuuaauuauuuuuuaagucaccauuuuuacuggcugcagaauguuucacagcaugauuugauuacaguuuauucauguaagcugccauugauagacucagaugguuccacuuuuccagcuagugaaaucaauagcacugcauauuuuaacuccauuuaaaagaguauugaaguacuuucuaugugcauauuuugcuuuuguucuaguuuuguucccaucuccaagcucauucaagucuuuaacauuucuaaguugcuaauggaccuucugcaauccuugaauuugguccaucugggcuaucccgugccauuucuugaucucaaaacuuucauccuuugccucaggugcuuguuuacugaucauggcuguccugugugucagaguauaccucagaauaucccuguccaguguguaucuaacccccacccaguggggugguccacaguaucucucuagauaugccaacauacucuucaggguuggagaugauccugguugagaaggagcaucaucugcugugauguguaucaaguguacuuuauaagaaaaaccaauacauggcagaaguuacuuuucuuauacauccaucuauacacgcgagccucauacuacauagcacagccacauggugcacaaggaugcuuuggucaguaaugggccacauacaugacagugaucccauaagacugucacuuggugacacuuggaaccaucugaauucuagugcauguggcaacuguauucugagcacaguauuucuugcaacguauuucucagaacaguuuccuaucauuaaaaaaacacauggcuguacuggaaauaaaucucaauauuguauucagagcuucaguuagcuccucugaacacuugacacuaaaaauauuuaguucauauuuuguguuuagguacaguguuuuuguuuauaaagcucuccauaucauuaucaggaacuuuugaguauuuucugguuguaguugaggcaacaccuauuuaguuagccacagaaauagcacaggaauuucaucauuuuacccacaaugcuuauauccaaauggggauuuaggccaucgacacuguccuacuagggcauuguugacacaaugaugacauguaggauucagugacaucagguggccaucaccucugcucccuccucuaguuacuucacucuccacagcuuuuggccucuacugaaguagccccaccuaagaggaccccuggggguaucuggccucuccauauguucuuguuccugugagaaggaacaaggaugcaguauagcauccuuuagguuucuucguuuuuuuacaagugacuauuuaggugauuuguuuaauuaaaagagggcguguguuauucuaucuaacaaaucuggcaucaagccuauaauuaaaagugugaccucuuauuaaggcuuuguuuguuuuuacaguaggccagguggccaggugacuuucugacuuacugccuuggccagauagccuauuauaaagaguaccugaugcucugugccuggucuguuugccuuuguggugagggaagacggcugagagccaccugucaugucuucagcucaucuuauaguuuugcuaguugaguugucaagguaauaggcaaacaugaagaugcauccacauaugaagaaauagcaaaacuauggccccagucaauagcaacaaggcuuccaucacuguagacaacucugugugccucucagucaggaagaaacugcaggcuguccucugucacugggacuuauuuaugcccugguuucaacuucauggcauuuguucuuugcucaauggcuuccuugauguagccgagaguuugugagauuuguuugugcugcagaauguaccaguggauuaugacaucugucugucugucugucugucucucuuucucucucucugccucuuucuuucaagacaugguuucucuguguaacccuggaucuucugaaacucacccaguaacccaggcuggccuugagcucagagaucuaucugccucugccuccugaguacugggauuacagguguauacuaccacucagcuaaauugggauugcugcugcuguggguuacagaagacuauacagacuugaacaggccacauuuuacuuaaucucucuacucacagccuuggguauuggcuuccuugccagugaucaucaguguaugauauugguguucauggaguguaggaacuucuuuugggggaacugcccaggaggagucuguucggcucaucuuuuguuuacauuuauuauauuugguauuuugcauagauuucucugcuacccccaggaacacauuuucccuuguacaccuuaguauauuuuaacagaugccauuuaacaccucuuuaaaccaagccuaauauagaacauucugauuauuaaagaaaauauagaguguuguguguucauucauucuuuguguuaccucaucuauuuaaaaaauaccucauuuauuuuaaaaaaugauuuuuccauacaugucuauaguaaaucagucuuauuucaaaagaggauuuaaaaaauauaaauauacauuuacacauuuuaaauuugaauuuagaauuuauuuuuuaugugugugguuguguugccugcauguauaucuguacacuguguacaugccugguuccuucagaggccagaaaagggcaucagauccccuggaacuggaguuaacagugguugugagccauuauggaugcugggaaucgaacccagauccucugcaagaacagccaguguuucuaacacugagacaucucuccaggcccacauauuuuuagaacaucuguguuuucugguaguuuucuucauguacguaccaugcccauuuauuuagaacaagagucacguacaucauaaauaaaaugcauuguuauggggggaaaaucuaaauuuuuguauuugaagaucgaguuuuauugcagcuuauuucaggcuaugguuuauggccuauaguucuuggucuaaaaauagcaccuaaugugacggucuuauuccugcugcugcugcugcugcuguuuguuuguuugcuuuuaguaggaguuucuugagaugacuuugguguuaaaggcucugggcuaccugaaugcaccgcaggugugaggugaggcuccauacaaucccuucagacaaaggccaaggcagacugacuuuuugcuuagguaacaucuguucccuaaaaauaaucucaacauccuaccuucucuaguugccacagcaagugaugucauguaugauuuguggauauuuaacuggugcccaguuaaagcaaagggagggacugggaccuccaagacagagacugcaggggccgcuggagaguucacauccucucaguucucuuucuaacacaugagaucugaguucccugaaccauccgucuguguaagugauaacauuucuaauagcagugugcuaggauuuguaggguauuuuucauucaaacaaaacauaucuaauuguaucauuuucuucaaaccaguuucaggccacaucuaagugugagguuggacaggugcccugucauuguaguacaggcccacaggggggucucugguaucagccauuuuguccaaguaguuuuguuguuugguuuuuaaacuuguacacacugcacauucuuagagaaguuuguuuguuugcuuggaagucaauacucacaaaucauacaugaugguuuaucgauacaucugcgguuauacuaaagauccuucauuagugauuucuggggagcaauuagauuguaggaaaagaguaguccuuuuggcccaacagaaaagccuuuuuuuccuuugaaagguucaguggacaacguaaaaagcauuugggcuuugcuccugcguggaguuuugaaggggaggguccuuccugguggagcaacugggaauucgggcguguaguucacgcucuccuguucuguacauucucucugugcuguuugucugucuguuuauauugcuacuuauuuuuacaguucugagcaaagagccccgagccuugcacaugcuaggagagugugcuagcccugacuuacauccccaguccuuuauuguugaacucagcauagaccucguguucagucuucaggugcugauacuuucagcuuacauuuugggaacacuucugacuccccauggaccacuuaaauugccauuuccucugcccaucuugguagaaguuguccacacuucuuacuuguaggcaagguuaucugcaucuuuauaagcugucagugugaggggacaugcagcgauaugcaucgagaacucccagcacugugaggcagagauuacaacaacgauugcagaaguagcaucaguuuugugggguuuuuuuggggggggggcuuuacauggaccucagauagaguggcaccucaugguuucaguucuuaauuaauuaccauccaaacugaugaggaagagccaucucacaucucugguuccaauccugugacuucaagccuggaauuuuuauguucaugcuugcuguuggcuugacucugccucaguuucccaagcuguaaagaggagcuucauauuucauagcucuugagaagacuucaaaacauaguggauauaaacaugucucacacaguuccuggccccauauaguggcuguucuuguucuugcugugggcaggaaacuguaguagaacuaggcagguauguaagugagaguuaucuagaggaauaaauuauauauauuuauauauacuuauaagcuauauauacauguauaugcauacauacacauaucacacacacacacauauauggugagagagagagagagagagagagagagagagagagagagagagagagagagagagagaaauuccagcaguagucaaguugacagaagggcauggagaguuuauauagguccugcuguacacacaugccagcuacaugaugugacuaaggguuacuuaaucucucaugaguuucaguuuccucacauauaaaaugaagaccacacauaugcaucacccaaggcuguuuugcgaaauaguaucauaaauugaaauagcacuguacuugguaucuaauuaccuuucaucaaauaauagaauaauuguguugcucguuggucuugucauuuuucuuaugguuugacugcuucuucauguuuuuuuguuuuguuuuuguuuuuguuuuuguuuaagacaggguuucucuguauagcccugccuguccuggaacucacuuuguagacuaggcuggccucgaacaugggccagcugcuaucccucuggauaacuauggccaccuucuaaccccugggccuacauggcugaaagaugcugacccaccuagacuuucccucacucaccccauuccuggcuuugucuccucucaguuuucacuguucuuucacacaaugcucuucacucacuccuucaaacacaccauauuccuuuccuggacccagcuuuucauguccuguuuguguuguuguuguuguuuuggcuuuuguuuuggugauaucuugguuuuuaaacacugguuuccucauuggagcauuccugacuucuuuucauucacauucuaacuuccccucuuuuaggguucucauggauccuuauacuuuacuuugaaugugccuuguacugcaucaugccacuugauauuucaugcccauuggcaugaccauccgaugaguacugggugugauccuaggucgucugucucacagccgagauguaagauuuggauugccacaguauccucagugagccugugugaccccccuccccucuguuuugaugaggagacaagagaaucaaagaaugaucaguuguauggggaauagcacucaucuggacaauguuggagaacagggagccuguggcugugaagcuuguccuggagagcauguacuuagagaagccagauaugcgcucuguuuggggcuccacgggaacccagugguuuguguacaugggaggggguacagaagugaaggccugggggacagaaagaggggagaugagcaugacacagcuggggacuguugaacauaggaaauggcugagcagggacucugaucuguaucuguccucugggaguguuugcuuguuuaugacccugauuuacaaugcuuucuucacccagggaugcagaauccauuuuacuguuguauuaacaccccccuacccccacccccgggagugaucaaagagccaacaguaguuugugaagacauuggccuuucuuuccuagggugaguuuuccuuuuucuuccuuggguuuggcuaucuuguaacuuguucaaucauaaacccagcaggucuuucuugugguucuuuguacuuaaaguugcuuaaucucuuugggucaguggucuguuguauaggguuucccuggugagcuucucacuucccaugcucucuguccucuuucccccuccucccucucucuccauucccccaccaccaugugcucauggcuggccuccacuucugccucuacuaccaccucaacuccccccuucaugcccugaauaaacucuauucuauacuauacugucuuagaagggaggccucaguguacaggugccuaucauuauaggaggauaaagaaacccacguuaaauaaaugugccucuucccauggcuuugucuuuuuccaugugaaacugaguuggcuuucuuuuucuuacccuuaaaugcucauuccauuauacacuguugcugcaaguagugucugcaugugggccgcccuugugagguccuugaaacccuguagaaacuuauccaaccuauuuuguauguuuguuucgguguaugaugcaccaugguggcccaaguaaccuuauauuaaauagcuuaaauaugggcagaucuucuucuuuuuaauucauuagguauaauuuaguauguaaaaaaguguaccucaauggaaauucuguuuuaaccccauuaaugaugaaaauuuacaaucaacagcaaugucuuucuguuacaaccuaagacuacuaucaugagaaguaauguguaaggggcauaucacacaugcucugguuucuaguagcauacugcuaagugccaaggccaccggggccacuggguaucuugggaugggagcugugcuuagcagaacuggugggaggaaguccuuagaagauugaaaagagauaguuaugauauauuuugaagaaggauuuugagagaucuuucuagauuucaugcagccuagaaaagugcacuaaacugaucauucugggugaagagcuagguggacaguguuggaagguuaggauuaucuguugaagucuccguguuaacacacugcacugccgauugacuauggcauaggcauaugguaaauaagaagcaagggccuugaagucuuucgguuugaaucuuggcacuugcaugaucaucugacaguaggaacaccacacaguccccgcaguugugagguugguggaagucaauuuaacaauucaacugccuguuacauaagcaagaucuuaguaaauauuagcuuuauuauuguuaggauuaugauuuuauaauucaaucaauagagcuaucauuugaugaaacuggucuuacaugcacuuuucauacaaagagauaaggcuuaaacagucaaagagacuugaguggagcggugcaucucaccuagguuuaacuugaaagaaacuuggcaauaucugaacagauuuggguuguuguaacagugggugcaggaugcugugggcaucuaguaagcaguagcuaggauguuucugaacauuucacaguauauaacaugaccuuccaaaauagagaguuucuggauucagauguuuuugucucugagguugaaaaacucugcccuaaggcugugggccccugggaaaaccaguaggaucagauagauccaccuuuucucauuaauaggcuuaggcaccacgaaacugcugcguuucuucacgagaccucaggaguaaaauaaaguuuuugacaaguccuuccacugaugucucaugccucgacugucuaugaagagacacugccaccaagagagugacaagccaagcagagaaaauaggagacaaccaagggaccagccauccacaaucacuaaccacuuguguuucuacagauucauuacuggucagcugugaccacuuacacaaggaacacugucccacauggcagaugucccauguggauaccccacacuagccuggguuugcuuucgacuucuguuuuaucggcaagggacuguacuggccucuuccugugagggucaggguuggucuugaccgugguuccucuucugcagcauccguccccucugucuuuuugccaaacuuugugugcaguuguaguucuaugauucccguugcagaacuggagcuggaguggacucuuccucaggagacugaggugcagcuuuagggaaggaagaaccuucggugggcucggucucaggcugauuuccagaaguucucuuguugugaaaugacuugugguguuuguaggaacaaucauacaguaucaauuucccuucaaauaugugaucaacucaccaagagauuggauuucauaaaaguacuuuaaaugacuuaaaaucauaaaaaugauuaaaaaaaauuuaaggugccuacuuuaauauaaugacagaaagucagcccaggugggcacacacacacaaccacaccucuuagaauggugaucugaaggcuuugacguucaacaauuuuccuuuuaaaccaugaaaaaaaaaaaaacaagucuggugucuguaguuccuauuuuuaugaacucuauugaguucauaaaauaacucaucauuauuucauuaaccagaaaauuucccccagugaggaagaggugaacuguuccuuggguuaugggaagucccugucuuagcagcacucauucauccuggauaagccacgcuggugcuuacaguuuuauuuccauccuugucugaagaaaaggcagcccguguggcagauauuccuuauuucccuugugcucagggaagaacucgcauucuucuggaccgcaagccacuguuucugcaaccacucuuguguccucugaagaguucuaacaauucaaaugcagugucuuggcaguucgauuguuucacucauaggacagccaacaucuggaacucuuugugaaguuguggaaacaagcaugcauuuguuauaaggugccauauugucuccuguugcuccuuccauuucauauuucuuccaugacuggcucacaaugcauccuuaugccuacuucuuuuuggagugggcaccaguauuugauaccacucuuagauuugacauuugcagcauaggauugagaagugcauaugcagagugaacugguauuuguugucugaagacaagcaagacuuuuuccuugauccuaauguccaaguucagcuccugcuuuccaugggacucuacagacucccagagaggccuagagggucagagauuuucuuccauggaagcucuaggccaaggaacacacagacauuggugauuugcugaguggaguguuagcaugcagcaggcuagacucugcagagucguaccaugucccuugaauuugcaaagcuuugaaguacaagauuugcuucugaaagccacacaagcagguuauugcacaggcagagagcucauuguugcaacacuagugugugcugcuuauucugagguuaggcucucaacacagguugccacuuacuggcuguucaguagagacagaagauaaagggcucuauugcugacucuguacucauucuguuuaaaguacugagaaaaauugagucaauucuaugacauaacuuugcauuguaacuuuuuaauggcuguacaauuuacuuuuguucucuuagguaaacaguucgaauuagaaaacuaauuugucuauugccacauuucuaaauauuuucuccaugucuuucccauuuuuaauauauauauguauauauuucuuacuuacaggguaacuaaaaccuuaaaguaacuaaaaucuugaugauaauucauaauuuuaacuaaaauuuuaguacuaguuugauaguuucagcccauuccuuaugguccccucugacuuggauuguuuaaagauuuguuuuggaccaaaaauaguggcuuguguccuaacucucugaggugauggcugucacagacaccugcugacuccucuccuuuggcaguaauuaagaacauugugugaucauguauuuuaaucaucguuuuauauuuauuuguugucauuucuccccuuauggcaggaagacuauucacaccauucucagcauuucaccaccaacgcaugaaagauaauagucagcaaauacuuggaaaauuaaaaauacgcuuaugugacuagacagagaauuucaauuuauuauccccguuguagauggauuaugaggaguccucguuuguaaauuuugcauguauacauuugaguagcccuaagcuuagagugagccauuuucucauucuuuuguuaauauuuuucuauucuaaaaaaauaaauauuuauuugaauguguguguguauguauguauugugaaacuauguauuguguguguguaucugugagaguauguguguguguguguguguguguguguguguguauguguguuuguguguguuugugugucuguaugagaauaugccacauguguucaggugcccaugaggccagaagagggugcuagauggagcuggaguuacaggcaguuaggagucaucugaucugagugccagacucuagccuucuggaagagcaauaagcacccucagccaccucuccagguuugauuuggucguuuauuuuuguucuuuuuuucuuuuuuuucagucagggcuuugcuaaugucuuacccuccccuguacuagugauugaauccagggccucaaacacaccagucaacacucugccaugcagacuccucccacaccagcccuggaauccaacugaugacaagaaaaucagugcuccguuuauaauuugaaguauuuuuuuuucccacagaagcauacauuuaauccuuucugaguuuguauaucuggucauaguuucccgggccucuuauagguggauucucaaggccauugcacaaagcccauacucacacacaccccaguuacuuuaaggcuggguuuugcagcuguugaugacagugaugagucuugucaaagacgaaagacaaaggcgucagagaagaucaaggaaggcaaucucccucuauaaguccuuuaauucuugccuuuauucgcuaagaggcuuuucugcaaauaacaugauucuaaugguuuagggaugugacucuucuccuggaaacuucaugaaccuaugaacuugaaaucggaauggugauuacugcuagucugauuccuuuuuguagcuaagacaggcaaaaaugcaagccaguaaaaugaauaacacaggaaauucugaugcccagcuuccuuuugaagauggucacacucauucuuuccugucugguucuuuguuggagauccuuaucaugcuguggagacugcugucaggauuccacccagaggacagcaguuaaguggccugcuccucucagggaagucccuggggagauauuuuuggcugggccagcuuuuucuguaacuggcacgguuuuacaugacuaguggcgguguugccuaccuucucuucuacuacauuccugaugugcaaugcgugacucugaagccacgggagggaugaaugacauacuuccuuguccugguuucuuaaacacuuuucauucagaaccuuuuuaacugauaaugugugugugugugugugugugugugugugugugugugugugugugugauauuuauuuaacuuuauuuuaugugcauuguugaguugggagcugccaugugggugcugggaauugaaccuggguccuuuagaagagcagacagugcucucaaccacuaagccaucucuccagccacugauugguaaaauuuuaacaaacuccuuguauaugggcauguagaaaugaccccuuguauaugaacauagagaaaaggcauacaaaucaaauauuuaauaguaauaaaucaaaauggaacuuauuuaguacacauauaaguuuuuacaauuuauuaaaaugaaagcaaauuuacaaaauaucggcacguaugugcuuccuuauuuuuauguaaaaaucacgucucgggggcuggagagauggcucgggggguaagagcacugacuguucuuccaaagauccugaguucaaaucccagcaaccacaugguggcucacaaccauccauaaugagauccgacacccucuucuggugugucugaagacagcuacaguguacuuauguauaauaaauaaauaaauaaauaaauaaaucuuuaaaaaaaaagaaucacgucucagcagaguauuugacacugcagaacaccuucaacacuuucucagaguugaucuguguuuugauuuuauaaucaccaaugcuaauaauguuuugccuuaguauguuguauaaaaauagcagaaauuucuuuagagccauuuuaaaauggcucucugaaacccaaacaaaaacucacugaauauuuuuuuguuuuuauuugguuuuuguguuuuauaaacucaagucaucaacuugaaaagcaacuuuaaaaaucaggcauuuaggcacaguauaauccaaaaaaagauauuaauuugguacuacaggggaacagugguagaaaaauauuccaagucuuuguuuucuaaaauugaaccauuggguuuaucguguuuccaaagagcagagcuuuguucagucaaacagcuuaaaccauaagacacagucaacucugagcugguguuguaggcuguguuuguugguguugccuguggcaauggcugguguacuguaaacugcacacccccccccccuauguuucagaagcaaggcugcagugcagucgcaugaugcaacacuagaaagcucuggcagaaacaccauggauucaguacgaauuucauuagaauuauguuuacccaugggacauucagaaaucuuuuaccauuggaaauuuuuugugaaugccccacacucuguuuuguggccucaugugacuuugugaaccccaguuuaugaaugcaagcugaggauauuauuuucugaucuuuggccaccugagaaucucuucuucagucugauuaaugggggauucagauguauaguuaaagaauaauucacaugcccuguuacugcuuugauggaauugaugaucaaauacuggcggaugcccaaagaagaugauuucauaaccuuuguuuaauuuuaucuuuccuuucucaagggcaguugguaagcaaagacuuuuuauguugauuaaagucuauuaauaaaugaaaauguaauuuccuuuauucuaccccauggcucaauuaggugaagcuggcuuguccucaacaugcacaugggcaaugccuucauuuacuaagugcaguaauuaagggagaacacuccaugcugaacuuuugagguagauaaaccacauugauuccuuuauuugggucaauguucuuucuacagccuuugaggcacugaccucaucaaagcaguaaaucuuuuggugacccacuuuguagcacuauggguaccacguugcuucucuggaaccauguugcuucucuggagucugucuaccauauuacuuauuuaguagccaaacccagugauucuaucaccaaauacaaucaaggguguugagggaaucaugauggugcucucugcugagugaucugguacauuggaaagcagccuaguuaguguaccucuuguuuuuuauucauauaacaauacauguugaacaaugggguggacuaggcuagacaugcagcucaggugguagaggucuugccuagugugcaugaaggccugguuuuaaucuuuagcacugugugacucaaguaugguggugcucaccuauaguccuagaaggcaggaaggaggguccgaaguucaaggacaccuaugguugcauagcaaguucaagaccaaccugggauaagacccugucaugaauaggauuaggauauauuuuccuaagauaucuauacucauuaauaacucaaccauuacuuuuuaacuacuugauauagugacugggcuaugacucugggcauucauugaugaaauauaacuagauagauuguauguuuuagacuaguuuggaaccucugugaaucaggugggcuacucuuaauaauuacuuuggggcaucagcugcagacagauuuugcuccagggaaagagggaagaacagacaguucuguuuaaaauggacaauguuuuuguucugugaauuucucgguccaugauggagucagagauaugaacucaguaauggauauuagcuaucaauauuagcauuaaaucugucauggguuauauaagaggauuugaucugguuauggucuaacaaagguuuuccuaagaaucaagaggucuuauugugaaaaagauuagggaaagaguauuucaaaagaaaaagcaaguacaaagaguaaguuuuuggauaguaggggaaaugguguguuuaaagaucagcaagaccaguguaacucaagcaggggguccugguggagcauguugugggaggagacuaggaagcuagcaagaguccacacuaugcaggaauuuaacaauccagguggggaaucuagaguuucccccuaccugcauuggagaguccuuccagaaguuauggaguaacagggauuaggaggaugugacucacauggcugcuaugugacaaguucacuugggcuacaguacagagaagagcugagcagacaugugaagggaagcagggacugugacaaacaucuggggagaguggguaaguggcucugugagucugauugaggggcucugaugaccuuaaggauaugguaaccugggcgacacagaaaguguaucguuugagaagcaguuagcagcagugcuacacgggguuugggcagugaauguaguaaggaauguaagggaugggaaaauucuucugugcccaccucuaauggcauaaaguccuguuguguccagucagcugcuuuuggaagugaauugggaacacggagcagaagucacagaacucuagggacuuuggaguuaguccccaagugaccaagaauguuucuggauacucuacaucucagaacauagcaauuuuaucaauucuuaggugccaccuggauacuauguauugucuauuauguggcacuagaacacugugaagugucuacugaggagagccacagguguuuaaauugguaugcuggagcuaguucugcugugucauugaccucuuaccugaucucuccuacauuaguccacugggcaguaugaccaaggugucauuuaggacaccagagcaacaauuuucuaaacaguaauagcuugguacauccagggguuaagguugcagcucccagcugccucaucuacgaucagguacaucuuagacacuggguccaacugguuuaucacaugauccuuuuacaagguuguugcucauauuaaggugugacguaauggagcuaaugcauugcaaacggaggccccgagcaucacaugagcauguauaaauaccaccaaaccaagugguccuuucuuucuaaaacacgaugcugugugaagacuuuugcuguggcccacagcggagcgccaggccagcaguaguaucugaaugcaguuguuugccacgggguaaugugcugucguuugcucuguuccggggcuuguuucauucauucucucuuccuuguuuguuuggcccuuuagcaauaguugagacagacagcaggucugucucaagaauccuguagucuuagcucagauguagcccuagaaggugaaauuucuauugacaagaaaaauuccacauauucuuuacagguuaaaacuuagcuucgguauucugagauucuuaagaugauauuuuucaacauucuuccaaaaacgcuuacuuuaauuaaauaaucagguacucuuugauggguuucuuuuaauuucuucugcuuagaccuugguugcuccaaaagaugacaguucuacccuaauaacacacagaguucaguuuccauuacugguuguuuuugauugaauggguauugggacauauuaagaaccauuuuuaaugcucacacucuccccugcuuccuuuuucuuucaugugucuugaguacuuauuguaagcaaguuugucuacuuuuggaccuccauccugaauuuagcauagcuagcaagaaguacuagguagccgggcaguggugguucaugucuuuaaucccagcacuugggaggcagaggcagaggcagaggcagaggcagaggcagaggcagaggcagaggcagaggcagaggcagaggcagaggcagaggcagaggcagaggcagaggcagaggcagaggcagaggcagaggcagaggcagauggauuucugaguucgaagccagccugguccacagagugagcuccaggauagccagggcuacacagagaaauccugucucgaaaaaccaaaaaaaaaaaaagaagaagaagaaggagaagaaggagaagaaggagaaggaggagaaggaggagaaggaggagaaggaggaggaggaggaggaggaggagaagaggaagaagaagaagaagaagaagaagaagaagaagaagaagaagaagaagaagaagaagaagaagcagcagcagcagcagcagcagcagcagcagcagcagcagcagcagcaguaguacuagguaucauuuuaaaaauuuuuguacagauuuugaaaaucaccuuguggcaugauuuugagauugacagguaucaaucaaucaggaauugcuuagguggcuccaacuuccgcuggccaggucauuuuuuuuacuaagcacaaacuuacacuuuauacuaaguauggcuaaguuucuccacucaguucuugacacauuuuacauggaguuacauaugagauuuccauucagacucucuaccuuaagcugaaucauuuuauuauugcccaauaugaauuuggguaacccaaagauuuauaugauagcuugaugcucaacuuugaagauuaaacaauaaagcuuguauuaaguauaggguuuuugggaucuuuuuggccuaccauuuuugaucuuugguuaaaagaugaaucuucuuuauaacuuuaaaaagauaugaucucaauacuuaucuauaaucagauaaggacacauguugcucuaaguuuuuuauggucuuuuuuaucuuaaagauccucauuaguaacuggucauaaugaugcaugccuacaaaaccaacauucuggaagcugaagcaaaaggaucaagaguuuaaggccaguguggacuacauacaucuaaggagcuuucugcuguagcagaagggcaaggcaucuucugaguuguuacccagcagcauguaugugagugcaguucuucaugugcacagagugagcaagaguuggagagugugggucuggagagugacucagcaccuaagagcacauauuguucaugcggaggaccuaaguucuguuccuagcacccauguccagugacucauaacugcucguaacuccagcuccaggggaucugacgcuucugaccucugugggaagcuguacucacguaugcauacucacauacagauauacacgcacacacauuuaaaaacagucuuuaaaaucucacauauauauguauguguacauauacauacauauacaucauauacauaagauuugaagguucuauuaaugucucauguuugcacauuaaaaugagcaggagagcauugaaaauacugcuuuuaggcagggaauaauggccagucaauaaagcaugaggaccagaaauuagauucuccagaauguacacaaaaggccaggcauggaggccugcgucuguaaugaaaacacuggggaugaagguauuucccuagaguucacuggccuguaagucuaguuugauugguaaguuccaggcugaguaagagacauaaacauggacacauacagcacauauacacacaaaaccaaccaaccaaacaaacaaacaaaaagcaccaaaccccaacauugcugucugagaucugggugguuugagugggguuaagguagggccuugauaauccuauugagcagcagcugguggugagacuuuaugaucuaaugguaggguguuuaugaguuuacacacuggaauugaugauagaguuauguaucaaggcagcaugauauacaaggagagcuauaccauuggcuauugagcaaagaagauugauugucagguucaagaugaaaucuuugguucuaauacccuauguauagagauugugggcgcaagagcugcaccacuucugugccacuuuaagcaagucaauauguaguuccaguccucucacccauaaaauaaaggccuugguuaaaugcagccagggugccuguauggugguagcauucugcuguuuuucuagaauguugauucaauggcccagcguaugggcuaucuaucaccagaaugguuuccugccuuguagccucguugccacccuucccccaccacaaauaaucaaauuagugggcauuuauccagagcuugccuuaucaccagagagucuaugcagaagaacucacuugggagggagaauggggagaugcuuaucuuuaucaucugugaagcacagaacuaagaggaagggcugugagaccuugauaaucaccuuggacccuguaugagccaugaagaauguauacacagaucugguacaguagcugugcaaagcaagaugcagaguuuauugcacuacagcuagauggccuugggauugaaugcuggugaagaugccucugccucugaccuagucucaauucuaaccuccccucccugcaaggaugcagccauauucccuccugccacugagcgaccgugagacuugccugccauuuccuggcuacuucuccuuccucacauuccccucaguggguuucuguuccuuggcaaccccagcugcuuugaguagaacauuaggucaagagacacuuuucaguaaccaauagggcaauacuaaaaauagaaacggcgcaggaacaauaagcuaaaucgugcaauguuguggaaagaaugaggguaguaaauuauagucuuagcccugucccgaaauagcacuaugaccuuauccaaggugcucgacacuaccaggguugucuaaaaugggaaugguguaaucucauagggauagugccaugaaaaaugcuuugggaaggcaaaagggcaugcuggugcaggguucuccugguuagauauuuggagagugcugacuuuuggauguugguuugcagccaggugaaguguauuugggaggccaccuucauuaagugcucauugccuucucagcugagauuccucugguccugucugcuauugauauuugcagccugauuuuucucccagugacuaguacucauuuuuagaguuucugauugcuuaacgccagaucggcuccaaguuuuccaauauauauucugagcuaucaguagaacucuccuguuuuuuuacacaagguacuugugauaauagaggggcuaucucugugugcuaccagucagggaccaagccauuagcauucuuugguuuaauucugugaagaccaacaacugggcugugcauguaaaugacuugguuaguugccuuucuuugccucaguugacacaugugagaucaccgugaugccuccuucucagugagucgaggacagugggaaaacuaggugucaaaauguucgggauggaagaacguuuucucugaccaaucaaucaucuuaguaucugaggagaggaagccagaguuagacauggcugccuuauucagagauguuacuggggcccacuaacaacacagugagguagcucaggagagaugaggucaauuagaaggggguuacccauccacgcaucaguacagugugccuggacucuguccaauccuuuucuuccuuuaugcauuugcacugaaugcauguguacuucucuucccuugaagugccguuguguuugaguacauuaggacaugaaagugauucucuuucucaucacaaauucagguuuaugagaggauucuugaugguuucuccuuguggaagacccaggccaguguucuuugcaguccagcuugcugugguggggaaaggaagauuauguaguucuguacuagaauucuccuaggccuuuagcagcuuucugcaucucuucagaucccagacauuugaguuuccuuuagaaggagaagacuuuauuucucucagggaaguaggaaugguaacuguaguaauguuuuugauagagauugacugacaggcaguuggaguucauaaugucagguuggguggggcagugaguucuagaaguacuuuuugguuuuguuuuuauuuuuaucauuuuggacaggugucacaaacaaaaaaugaggagaugcaagagggcuggcaaauucauucucuucuuuggauccacugagagucauaguaacucaccgagggcacuagugucuguauuagcugcacaaaggcaauaugguucacguuuguuucauccgauccucaucugugaaggaaauggcagaaaguucagcucguggaaacuagaaagauuaccaugccauuggucagacuacuacuugcuuuccuuggacagacuuugguuguuuuccaaauauagugaguugacaaugccccaugggauuagcuuuguuguguguuguauaaugugacuaacgaguugguugcuugguucacuuaguaagucuuuucuaauugcauauuuaaaaaauacuuuugugacauuuaauuaagugagagagagagagugugugugugagugugugugugcaaguguguuguacacuugugugcaugcacagaggccagaggauaaccuucaggggucaauuuuuccaccuugugaccucaggggauuguacucaagucaccaggcucgguggcaggcaucuuuaccuucugagacaucucaccaacccucauuccauauuuuuuagacuacuguuuacaucuuuuguauaaucuagauguugcuauuauaagagaugugccagauauuauucuaauacugucuauuggaacauggagcaagguuccaggcaucuucucuccacagagucacauaggagucacucaguucccucaacaaaugaagcucgccagagcuuggugugcagggcuuuuauuaggguucaaauaaucucucugugagcugaguuuuauuaaguacucagaugccagaaccuccucccuagucaaagaagcauuuacuguaaaaaaucaugccacuagcauaacugguccugguaaauuuguguaguccaagguuccacaguuauaaaaauagauauucacuauaaguaacaugaaacuaaaacuccaugcauauagaaacacaaugaauagaagaauagaauagaauagaauggaauggaauagaauagaauagaagccucuccugcauucucugguguugaccaacucuguccuucugagcugauuuuuucuuucauucucuuguaucuuguaaucugucacuggaagcuaguccuugaguauguugacccucuugugagucugaauuuuucuuuccccuuaaggaauguugauuuccuucuggugaucaguuaauuugcuuauugaucaguuugauuguuuucagguuuauuuuuaaacuuugagauuagaucuagcauagucuuguuauaugccuaguuuaaccuucuauuucucuuauugucucuuucuucuucucucucugucugucucuguuugugguuguguguauacgugcgugcucagguagauaugugugcagacacauguagacaauucgguuuuguccucuggcucucucauccuaucuuguuuuuuuuuuuuuuuuuuuuuuuuuuugagacaagaucucucaguggucuggagcuugucaaggaggacaggcugucugggcugcaagcccaggcagcugcaugucugcuuccuaguagagggauuacaguaugugucaccacaccaggcuucuagggacggaacucuuggguccuuaugcuuacaagcugagcccugccguacuuuucucauuuuuggagucuuccugacuauuucagcuuugaugaggucucucuucuguggcagguuguaagcugaacaucucucaccccucugagaacucugagaggaccuccuucuuugguuagcuguucuaccucuaauagguguucuuuccccagcccuagaaagcccaccugcuugcuaucuagcuuaagauuucaggggaucucugugaagcuuuccagaucuuuuuauuguuacacuagagagaaaccaugauuaucucuacauugcuucccuaaaacacaaaguaggcauagaauuucuaugugccaagugaacacagucuggguuuugaguuggauuucuguauuccauuuggaacacacuaaauuuaaguaaaaauuauguggauauguuaauaacuacuuuauaauugguuuuagggggucaaagaucuauauuuaaauuaaggaaggggaauagguauagcucagugguagagugcuugccuaagaguguaugaaauccuggguuuccucuucagcacuagauaaauacauauauaauuaagagaaaguguuugcuguuaagggaagugacacuauacuccauaucaauaguuauuuaauuugcuaaacuauuugaaacauggcagccgugggcugggaagaugaguaagugcuuguuaaguggacaugagggccugaguuuggauauccaguacccacugaaaagcuaggcuggguggcuauaaucuccuugcuggcaagguggauacagaaagauuccugggacuuucuggucagccagccuagcugaguuaguguguuccugguuuagugagaugccuugucucaaagaaccagguagacugugaaaaggacgacgucgccccaguguugcccucuggccuccacaucuaccuguacgugugcacauguccauaaacgcagagcacauauacacauaaaacaauacacacaaauacaaaauaugauugcaaguuuaugugcuuaugaagaaguucaaagauugacuuuuuaaagugaaaagcagcaaucgguuuccccuucucgauucugauuaguagguuacaauuucaguaagguuugcuuuugagaaaaaugaaauacguuuauggauaucaucacuguaauacucaggaaaggcaacuguacuuacugaguuaaaggucagaugguuaaagcaacuuuaaaauuugccuugaaaggacagagccuccucaauauuagcugugcuuccuuuaagcuuccucaaaggccuauccugaacaaggcucagccuugcuuucuccucuuugcaaagaugcuauaucaaagacacacuaauuuaagcccugcuacuguccagauguagcagcugcgaagaaccagguucagaaggucaccauuuggaacugcuuaagccaggacaaacuuccugcugugauugcaugucugccggagaaacugguaguucuuuggggccaggccuguuccauuacaccagauggagccgcaguguggcuggucagagagaagccagagugugagcuugucuaaggaguaaggcaauacccaaaauagcugcuucucuugacaauagccaugcccuugcaaccagaacuguuuguguuggaagagagaaaucuuaaggcuuacauugucugcuaugguagcagguggcuacugaguccuugaaauauagcuagccauaauuauauuuauaagaguaaaaucuacagcagauuucuuagguuuauauuuuuaaaaugugaaguaucuuguuaauuugucauauuuucauucuuuugacaacuucacacacacacuauagcuaucuaucuaucuaucuaucuauauguaaaaugugccuugauuauacaaguaguauuuggggcauguuggguuaaauauauuaauaacaaugauuuuuacccacauuuuguuuuugcuuuuuaacguaccugcugggaaguguauacauaccuguucguuucccuucuguuuuugcugagcagagugccugugggggcauccauacuaggaaugugacauuauuccgaacuauacuuugauuuugagaguugauuuugaaauccaucaucaaguauggaauuagauccuuuggauugccaagcuaguuucucaguaacccauagcgcauaugcaauaaugacagcaagaaugaaacuuuuuuuuuucagucagaaaagcaauuucuagaaaccaugagcucugcagagcuaaaauuucauucucauuguuuuauuuuuaagcucuauuuuaaguuucuuccaggacgaaaauguucagucccuucuggauucugauguccugguaaaucuucuuugugaaccugggggaugugauagaacuggcacaagagaaaauuaauuugguugggauccaugaauggagcgggggguaaugggcaagccuuguggaggcuguguaauccaucacuguacaagguuugcuagguugccgagcugcguggcaccuucuguuucgggcagcaucgugccaagauuaacuccuguagaacccugcucuucuguauuaggagaaagcauacgcauaauagaaugugacuauagaacauguauauucgcagucaauaaaaaugcuucuaucuguccuucuguauguaugguguguguguccauugugugcucugaaauaaaaucaaaugggcuuuaccacaauuuuuucucuuucauccuaggguauuuuccuacccuuuauuuucuacuaauuugaacuccaaacucacuguaucaggguacugucuuguugaaggcaagucaaugcugggagccauuuaacuccauuuaucaaucacaugacacuggacuuggugauauauuaagaacaagaugcccccuccuccaccccucaacuucccacuguuuugcuucuuucucauuguugaaacccagaauucaaaacugguuuggaggcucuguguagaagugcauuccagagcaugccacuaaaugggauauaaauagcauuugcccugacagagcuggaguuuucucagcucuagagacauugaagccuuuguuuugugggucacuggccccucccccucaagccugagucauaaagcccgaaacacuaaugagguugcugaaauguaaaaucuaauugguaagauguaugggaaaccaugagcgaguagaacccuaaaccucaauucaagugacuucccuaucuggcccauagcuugcauacguugucaucuguuguuccaaacccuucaguuuaguuguuucuuccaguaggaucaaaguaggccuagacugggcuggggauguauagccauauagguuaauagaaggauccugaauucuccauuuagaaaaggggaaaaguccaugaaagaaagaguauguuguauuuuuaaauuuuuaauauauauguguauauauaaucugcauacuugauuauacauuuaaauacagauauaaacuuaauuauauauauguauacauguauaagcuugauuauauuuguacacauauauaauuguauguguauguauauaaauguauauauguauauguaaauauauauuauauaucauacuuauagcuauauaacauauuuuauauagaacauaguauauuuauauuaaauauuuaugauauauauauuguuuuauauauauauauauauauauauauauaaaacaaaauaguuuucuauuguauucugaauguacauauaauaguucauuuaucaaaguaucaccuguaucuggcuuggaauaacucugaaauaagaauggcuuuuauauuuagcauuuuccccaguuaucugaaauugaagaaucaagaaaaaagaagacauaauaaagaaagaccaaacauggcucaccaagucuaaacuauguugcuggucuguggguuccuagccuuguauccacagagcugcuugcugccugcuauaggguguacuugcugcuagacucaucaacaaacacauaauuccccaacauucuuucuuuuucuaucucugguuccauauagauacugggcaaauaacguuuacaaagugaugccucugccuucacaguccugggagguggagugacagucaccaagggaggucuguguagcucagccucugcuucccucuuugcuguguauuauggaauugugacuaauugauuuuccagauuuugaauucauccacucccucccccccacagaccacuugcuugcuuuuccuggugacuuccucauuuuccuuuauuuuuuucuuccccaaagucuccuacugcccuagguaaaacccaucuuuccucucaccugaauaccgucaguuggugucucugagguauacuuaacauuuuuuuuuccugugacuucaaguuucgugcuauguucagcauggagcugucaucuagccuugauuuuguaaucaugaacccaggcuaccuugacaaguaucccaagccagguggcauacauaacagauauuuauuuccccugacucuggugucuaaaguucaaggucaagguacugacagaccuaguucccagugagaguauguuucuuuuacuguugccuaccuucuggccguguccucacauugccuuuccugagugcgggcagaucugucuucuucuagaguagguacagguuccaucuaagccuucuacucuugaccccauauaaaccugauaacuccaaagccucuuuugccaaggacuuuagcuuuguuuggguguguuuguguaggaaggcagucaguaugaauuuugggagccuauaaacagcucauaacaguuguuuaugauuguuuuauuuauucuguagauaugaguuuugguuuuuugauauuccuuuuggcaacagggucuuuccagauguuucuagaaagcuagacauuugugcuugcaugcacugaacuugaacauauagguuugacccuggccuuuauuuuggauccuuccugcuguuggaacccauuguaacaguacaagaucacagcugcugcuuuccuaagcacucacagacacugacuuguuuuguaguucagaguaugcccucuggccucuguuuuggcuagcaggauagccagagcauggccagaaggccacggcugacacaucccagacacaugcaggccucaaauugcccucuuucaaaacaauuacaacagccauguaaauggcuaauguaaggggcaaaaaugagcacauuauuuauggcucagcuagagauuugcuacccaaagucugucagccuuugucagaagacuggucgugccagugacuguggcagcuuggaaaagcauugcggccaauggcuauugggaugaacucggagucugguagaagaucauggggauggaucccagagcacagaagcuccacacuugacucaagugguugcauuauccuguccuguuuacaucucuacagcucuccucccacugaaugaguuucaucaccagugaugagggcagcucucaaaagagcauguucaugucuguggcaugcaucugcgucugcagugugaugggcucuuagacuugaaggugcuugcuugauguaggcuagguacuugucuguuaccucuaagaucuaaguugaggguuuagggagacggcucuguugguaagaugcccgcaugaguuugguucccaaacagccaugugaauauccguguguaguggugguuggaacaaugccagagcagagguaauagaagcaggugcaucccuggagccaaccuaggcagucugcgagcuccaguuucaaugagagacccugccucaaaagacaaagaacaaaacaacaacaggagcaacaaaaaccccaagccaauguggagagugagugcagaaagcaccugacuuugauuuugacuacugauuuccacauggguuagauaugucuauguauaacacucauguaccaugcauacaaaugaguauacuauacacauacaaaaauggggaaaacauagaagacucaaauucauccuugacuauuugagcuaugaaaauaggugugggcccuuuagauaguacaaugcucagcuaugucagauggaccuggacccauuagauagcacaguguucagucaaucaggggaugcuggagagacauugcaggagaaagguggccuccucccauccggguacaugcucacucaacuucugcagcacuccuggcuucuccgugguguggcucgggaagcaugggaaagauggccagugcuuguuuccugccguggaugugaccuuaucuccuagaucucacaguguggguggcucuccucaucagagcccucccacuccugcugugcacgcugcccaagguugaacccaguauuagcagcgucccuugaagguguagcagagucccuugcuuggaacaaguucccaugaaccggcuuuuccuggcagcuuugaggauggauucuagucauguccacagagaaagcauugcugcaguggugagguuuacagcugaagagggaaggccuucacacaagcccuaccucagaaccagguaauggcugcuccuuaugucugccuuuccuagagucuucaaggcucucuuagccucuucccugcagaucucuucuugcaaccgauaccuuuucuuagccuuucaauuucaaacugucauguguuuccucucucuggcuuaaacuuucacaccaugugccaccaaugaaguucuguucuuacacgugugccagucagcucuucccugcugaaauguguaccuacgauaaaucaguuauagaaagaaaaacguuauuuuggcucuuuguuuuggaggcucaaauuugcaagggauuggucccuugcuuuggacuucuacugguacaccauaguaagagagcaugguagaucagaaugcucaccuucauggcuaggaagaaaagagagaaagaagaaacuggggucucaaacuccccuuaaagaccaugugacugaugaccuacaacuuucuaggagaucuuaucucuugcaguuuccaucacuucuuaucggcaccacucuggggaacaagccuuugaacacauaggucuuuaggagauauuugagaugcaaacuguggcauaaauggggggaugguucuaguggaucagugcaaaggcgcuugggugucauggcgcauguuugugcuaugauaucugccugaauagauuaagcuuaggaaagucucuggcaguguaggagagaauggugcuuccagucauccugagguaaaacacaacaaacugaccaucaugcuguguugggugcuuuccagagcuauggaccaggcugcugagaggccccguugguuuauggggacuuugugcagugcuguuuaucuccacugauaauccugagugguuaaauggacagucaaggguggaccgcuucuucccuugcauccugagauagggcuagaggcaggccucuucucuuccucuuucugggugaguacuguaucagugugauagaacaaaugccacacucgggcgggggguggggggaagagacagagauggcacuagaauggggugacauuugagagccauguguuuugaugccuacauguuugagguugaaaguugaucucagguuuaauugagugccucacucuuuuaaguaugaaaucucugagaaugcuccccucagccuaaucugcuagucaguuuuccucagccucuuauaaguacauccuuccuucuuguguaugcuuuuaguagcaaguccuuuucucuguucuccuccccuccccuccucucuucucuguccucuucuuucccuuccuccuuaucucuuucuugacauuuacauuaacuuguaguaccaaaccaguaaucagaaaauauaucagaugugcggaaaacuaaguuuuuaagcuaguggcccgggccuucaaagaacuccuguuugucauuaaauuaugucugggcauguuugauguaacccacaaggaauccacagcauggaagugcuaggaagcgucaagguguuggucuuggauucugcuucuaggaaaugcaugcgagaauucuaauuaagaccuucuuugccuuuaugugcagcuggccucaagcuaugacuccaacuaggucccagcaccagcuuaaugggagcugaugcuaagugcagcuugcuccccucuggaaugcacacugcuuggucuuugggaaaaucauuaacucuccuuggcuuaaggagcuuugacgagagauugcaggauuauguguguaugguuucaaagguuauauuuuuaagaugaauaauuuaagaagauuaggcagcauccuucauuaaucugcagcuauuuuaaugauuaaaaaggacaaccuacuuucaucccagaagcauaauaugacagcuuugccuauagguucugccuaauuaaaguuugugucaauuguagaagguagcuuuaaguagcugaggcuaauucaccuggaacugauguagggcugcaucuguggcugaaguggacagaagcucaucagagguuguaaacuguagcauucuaguguacacaauacauuugcuacuguagaucuucagacacauaaauguagacucuagucacaaagagaccauaucucaaauagauagacauaaaaauuucucuauauaagaugaaucuagugguauuauucuccucaauauaaaguguguuaugaaaugaacaauaaucugacuugauaucuguguuuaaaaccuggcugauucuaaucagaagccuaaucagguguuaacuuaccuuuagagucugacaucacaagcaucaaagaccugcuaauuuuauuccuugcugggccauauacguggaggugaggaaucagcagaaggcagaaagcuaauuguuucauuauuagcuggagaacaaaauguuggcagugaauuaaaggauggacucaagugguguguguguguguguguguguucuaagaguguguccucaaaguagcacccauggacuggauugggcuaguuuaugaaccaguucuacaaugggagaaaacaagaaucaucaucaacccauagagcaaacaaagaaucgcuugaaucucgucuagugauaugcauacaggauuguacccuuacugaucuacuguguuuuccaucucauucaggauuguauccuuacugaucuacucuguuuuccaucucaugcuucugagaauucacuuuuauuauaauucaguauguaauauugaguuauaauaguauauaguaucaaucugugguugugacucaguaaacaauugcuagagauaacgggaagcuuguguggggguguguauggagguauggguagucaguauuacuguaacaggaaugggguguaaguuguaaagucacauggagauggguuauaaauacagaauaccguggcucgcaugucaguaguguuucaaaguaccugucccuuucuuuuuagcacaguuaaucugcuauagugguauuuauauccacuuagguccuagacaagagcuccucaaguuuuuccuauuuacaguuccuuuuugcaugaaacuguuuuuuuuuuuuuuuuuguuauauauccaaaacguguuuauugggaagguucccacucaucuucaaccaggggcugaagugcugcuuccuccugaaggaguguccuucugucagccuugcuuucccaccuguaggcugacagaggacaguggagcagccaacacacaagacuaccguuugugcauggcugaaaaccguggugauuuuauagcauccugggcauuucauguccauaaaguaggaacuggggcucugcaccaggcacuuuuucuuguguuuccuccucuccucuucuggagagggauggaggagauccuuugcgagaggcauguucucguagggagguugucaccgccggaaagggaaaaguuuuuuacuugacucuguuauacaggcauauaaaauacauaugaaaaccaaaaauuuauugauaauaaaucauaaagaaguuuauuuaaaaugauuuugcuauacauauaauucuauucuucuuaaagacuuaaagaauucacauacuaguuaguggauuuuguugcaaguuuuuauauaaaaaauuaaaccuuuggcugauucuuuggcacuagagaucaccgaacaucuucagccauuuuguagagguggccuauauuuugauuuuuaugaccauccaugcugggaacacagguaguauaaaauggcaaaaccauuuuagaaaucauugaaaauucuauuuuuuucuuauuccauugaaugacuuuuuaaaaaaagaaagaaacucaagccauugacucaaacaacaaaccuuaagagucaaauauucuaacauaauacaauccaaagauauguaaauugauagaugcugacaaagaucaguaaaauauauuacaagucuuuguuuucaacaauuaaaucauaugcuuauaaaauuuuguauguacaguaaaaacaucacaauucaugaagacaguagucucaaaucugagcagcaguccuuggcaucauguagcaugaggacaugcgcaauacaaaucgcacuuacugugugagcauccagaaccaaggcugcgguggacuuccaugcuccacugugggcgagcacugccagaaacaccucuggcucuuuauccaguugauccucaauucaauuuguuaucgugcauucagagaccuuuuaguguugagaauuuuuuucuugucccaaacauuuguuaugugacccugucugggccaaugacccaccauuuaagaaucuggauuguagauugauuuccaaaaaggcucuuuggauuuuuuucaaccaauugugagcucuugauggagcaauuaguuugugguagacacugcauugugcacugagacuuuagaaguagcaggauaacagaugauguuggauuucuuguagcuaaaaugaaauaaauccaaguguguaaauauguacauguauauacacaugaacauacccacauaaaacuacaaacuagugggcccccuccauggguugcgugaucauguuaauuuugucugcuacugcaucuugacugugacuuuuaagaaucuucccaaugcaaucguguaucuaaacacugugggagaugacaugucucaggucauaaauguggggucagcccguagagcaccaguacuccucgcuuugaugagaacguuggaacacgggcuuccucacacucugagaagcccugccauuccccgagccauguuacugucuguuuugcugcacagcacacaagagauagguaaaguaaagguguugguucaguguggacucugcucaucugcaggaucaaguucuagcugucuagacuggaaugucuuggaaguguuagucuuuaacccaaaaugguguuggggaguguauuuucagaaugggggcccuuuugauuccaccagauucugcaagugguuuaggucugccaaagcugaagagucgugggugcuuaaagagccuucuauaguuaguucggcugauuauccucccugguaagacuucuuucuuuccaccacucauaggucugugcuagugcuggacugaauucccuacugcuccagcaguaucgcauccuaucuggauagucucugccuagcagaccugaccucuaaccauaccccgagcuuauuggcuuucugcccuuacaccuuugcuccauaaguacucucuggggcuacacuuccaucccuucaucccuuaguugcuucaguuuuaccuuugaugcuucuugcuauuguucucagcccuggcuacccuuaacacuugauguagcguauuuguuagguuuuuguuuauauucuuuccccauccuauugcuucauagaggugcagacucuuaccucuuuauucauuucaguacacugagcagcacaagagcuacauggcacauaguggaugcuuagcauuugcccauugugugagcaaaugaagauaagacucuuacccuguuacagcauauaacccagaacuuaacuaaaugugccuuuagcuggaguuccuuacauugcuguaaagcagucauuuucagccuguggauugcaaucccuuuggcaaaccucucucuccaaaaaauauuuagauuaagauucacaacaguagcaaaauuacacuuaugaaguggcaacuuaccguaacaugagaaguugaauuaaagggucgcugcauuaggaagguugagaaccacugcucuaaaggacuuccaucccauuguccaugacucucaggucuuacguugcuauaaccuuugaugugucuauaucccuuuaucuuuucaggcugcagauagccccauguggcauuuccauccucucauuuuuaaccucuuggucuuaccuuauccuagaacucaagaggaauugggagacgagacacauuaucuguccucucuccaucucuccucucuucgggacagcagaauaauucugcugagcucugcaggauugcuagagggugaaaugaggugaugcauaggccguggccagcauagugcuugcuguaaauaucagcugaggugcugcgcauggagucaccuaagguacaggucagcaugaagucuggcacaagguaggaaaaaggaaguggcagcugucagcacuugcagacccccaccccuuauuaccuugacuaaugauacuccugcucccagagagucagcccaaaggaggagggcacuugcagacaauuucaaagacacccaggagcuggcuuggcuuuucuuuucucaucuuucucuuccuuacuuccucccuuguccaugcuacaugugacuaguuuuucauuccucguuaugcacaggaaggucuauuagauccagaaccuaccugugguuguaugcuauaacucugguugugagggcagacauuuuaaucaagucuuuauuuuuuuccguaacguuccaugugagugucucucauuaaguaacgcacccagauccucaagaaguacuuccacauguauuccuugacaaccuggauuucuggcuaugauuucauuucugugaggguguuucagggagcuaccuugcacauuugcggaugucugaauuuuuggccugcccucuuuaccccucugugccagguuaguaaagcuugcucaacuugaaccugccaauuacucagucagcaaauauuuauuaaguuuguccgugggggaauggcagaaugacaggacaaaaggcaagcuuuggaaagguuaaucuggagggcuguggguguaacuggagggggcuuugcaaaggcagcagggaagggugaauacagaugagauucaaccagagucagagcggaucaggguucacagggguagugugugugugcaugugugugugugugugugugugugugcauguauguguguguauggcuguaucuguguauauguaugaauguauguauguauauauguugaauauauauaugaauggauguauuaugugugugugucuguguguguguauauauguauauauauauguauauguauaaaugaauguaugugugaauguauguaugaauguccuaucaguauguauauaucaaugaauuaauguguguauguauguauguauguauguaucuauguauguguguauguaucuauguauguguguauguaucuauguauguguguauguaucuauguauguguguauguaucuauguauguaucuauguaucuauguauguguguauguaucuauguauguguguauguaucuauguauguguguauguaucuauguauguguguauguaucuauguauguguguauguauauaugcccagagucccaggguccaaccagucccucagagaaagugucuuaauuuacauuugaucugcagcaaugaccugggguuuugcuuggucuuugaucuugccaauacuugguuuuaauugcuucaacaauuacgcaaguaaauaccguacccacgucccccacccccacccuguucucuuucaugacuccucuggagcugggcugggcaguaccugguucagucucuccugaggucauagacagaugguggcugccaggcuuucagaagaggaaaccauuggugaugaguuuguaucacuacuuacuauauuuuuccaucuccaggauagggcugggcuggggcagugcaaagaauccacucauucaaggucauacagucugguccugcaaaggagugggcagcucuuuauugagugucuaccaaacaguaggcuaggucaaggugugcuccauuuuaugggcuguuucauuuucuguaaucuggucuuuccuuuagaguucauucuuggacuuccuguccuucauccucccaucuuccaguacacucuuuacuuuauauccuaugucacccaacucacugcgccacagcccuuucccaggucacaucuugugcaguuauuggcugauucacuucuugucuccagccucugacgcuaagcaaaggugugugauagccacucaggcaucuccaccgcucuguggagcauccaguaggagagcucaugauaucaguaaaaucugcauuauagauuaaauaccauuuuaguauaaacauaacuugaacaggggauuuuaggcaagguauauuucaaucugggacaagcuuacagugaaaauugcuuaugaguuuucugaaccucagauugaacuggaagccugauaguauccuuugcuaaaccuaccagcccuaugaacuuguauuuggcugaguguauaccagaucacagacgcucgggauauguucgaacgggcaaagagugaccacaucaaagaauguauuucuuuauucugagcaguuauuuuauagcuaugagaggugcagauaauacaauacccuuguccuugagcccggacucaguuaauauaacucaggaaugggaguuaguuuuggaggcugcagacuuuggcuuucaggucauguucagauccauguaccauaucacucugccucacuucauuaaaagaacuuuccuucuguggccauuagauuucuuggcuguaucuuaaguugaacucucccaguaagcccaaugagaguuuauuaaaggauucccagaaucccuggagcccugugaagccaagaguaagauggggaugugcggugagcagcaaggcaguaguagcgugguaguccugagcccauggggaugaugaauguucuccauggacacacagaccgccauugguguucuccuaaugccaccuugacagcgugccacacaacuaaacccuggugccgaaacuaccagugaacaugucgcucugcuguuucugacuuaccuaagugaccgagcuaaggucccuuucugcauccugcaagcagggaagucaggggauggagaccuuuagcuucuaaugcuaaagcuaaagcuuccuuguaaacucaugaaagagaguuuuguuuuuguuuuuuuucucucuaagaaaugucuuaaagaugcugaggagccuaaaugacaacauguguccacauggcaccaacauaauacuacuacaguagcacugugccuagggauguuuucuugaacaaacuguugugucugugacuugugugaaaacuaaagugguguuuacuuuuguguguauaugugcaugugugcauguguguuuguauauguguguguguuugcacauggccaagaagguacuugaaggacaguaggguggaauaguggcuuuaauucugucugaauuguugucaaaaugccccuuuauugaauguaugugaugaaaacagcuaaagaauucaaaacuugguuaauuuacugagcaaaaguguaagucagaaauuccuuauccacaguucugaaaucaaaacgucuccuagaauguugaaggaugucgauuuuuuuucugaaccuaaccugagcugacagaagguuauuuauagucuuuauuaucccacuuacuugaauauucauguuuucuagcagaaauauuaaugugcuugauuauagauauuacuuugaucucaaugagaauauucuauuauauguggcuguuauccucauaauauccggaauauuguuguguucaauauuuaucagucuccagaauuuuagugcuuuuaaaguaugugucuuuguuugugugucugugugagugugugugugugugugugugugugccuccaggagaccuauacauagaaaguucuagaaggauagaguacucagguuuuaaugcaaggaucaagugcagagacaaugagaaauugaucuaagccucauauucaguaaucucuaauaauuauuauaaucaaacaauauugacguauuuaaugcaaaaagagaaguaaguugaauggcuguuucguaggacuuaggaaaaugauaggaguauaaauuuucaaaucaaagcugauuugucugccaagccaugcuuucauauauuagcucaacauugcugccugcugacagagagccagaaaaaauuauacacaaaacagucagauuccugccucuuggacaaggacagggaauugacaucagcaaaaaaaaaaaaacaaaaaaaaacaaaaaaaaaaaaccaguaauuucacuaaagaaaauaaauaaaagcacauaaaaaugccgugaguagaugaaacugcccuuccuagugauggguuuggcauguuuuauaaagucgccacgauuacucauccacuauacguuugcagaaguucuuuuucaaaagccagauacacagacagucacagagguuaguagguggaugggaagauuaagcccagugagguuacguaucuuguccacaggcugcucuucugugucagccuaugggauggcuucccaggguaagucugauuuugcuuucuccuauggauaaguagcagagaaggguugggcagucuccuuuugcauggguuguguaagucgccaauuucuuuagugagaaggguguucauuggaccccagcauauucugggguucuugcuuccuggcuucaucuccuguugauuuuuagagucuggugcuugagugacucucugagguuccauggaaacauggagcuggaauguggagacagaaugguaggguugaacugcagcgucuuauguuucuuaugaggcaguuucuuguuagugcggcacacugcuugaguuuuuacuucuuucuuucuuucuuucuuucuuucuuucuuucuuucuuuuuuuuuuaugagcuuagccaugguuugguuugcugagugaccacuggugcuuuaugacauagagcaaugguuccagcuuuucuuucauacuggaaaaaauuucacacgucugucaaugugaagcuaguuugcucuuuucuuuuucgaacuuauaauaauuuuaaacaugaccuuaagucccuugguucugacuucagaggacauuggcuguuggggucagacaaagugaggguuggccacgcuguuacaaaugagcuuuguaguaauuacugcugagaucauaaaacucggcuuucccacugcaugucaaugcuccuuuucauuauauagugcuuggaacaaaaucaugugauuuuuuuuuuaaaagcuuaaacauaaccauguuugaaaggcaguuuucauuuuguggcuuuuuuuuucuucccccuuuccggugucuaguacagccaaggauuuuaucuucuuguaucuuuuuuggcacucuagugaguaauccauucugaguuacuuucucacuagaagagcuggucaccuucuuagccaugguggauguucccccuccccacuuccucuccaucgauggacccaagacaugacugugcccaaugguuuaccccgauggcaauggcaucucaauggaggcucagcagggagaucaggcuugauaccguugggugauauagccaguggcucaagagggaacuuaagucuguaaauauggaacgguuucucccgagauuaacagguuaaaaagugugugaggacuucaguugauauuuuaacaaaugaagacauuuccacgaggaccuuuacagagcacaacacugaaccucuagagcuuagggucucacaugaaaauauuggcauccuugggcccuaugaccuugugccaacgagugcagugggaaguuguguggcuugacucucuggaguaucaguaguucuuagguguucacagugacacagauguaucuaauucagcuggucaguaguugaaaagcuuucucaggcugauauagaggcacagaauggggcagagcauggaauggaaucuguaaagagauguuuacuaugcucagggugacuuuagaucacccugugacagggccauuaccuguccuugagaagaugguccugucuucccuguccuuaaguauaagaugggcuuugguacaaucuucucaaauacagccgcucuaggaaaguuguuguaggcacaagggggaguccuguaauaccugcaagaguuucuggccagguucagcuaaacaguacauccauccuaucauacacggagaugacuugaaaggacaggaaucuugacagaaggccauaugcacauguagauacuguugggauaaugagacguugucuucccugagagaagucauagcaucaaauauggaggcaacacuugaaggcacuggauguaaccuuguaauuuccuagaguucuuccuucaccauucuuagaccacaacagugacugagcagcauauucuuuaaaaggagagaaaucaaguacaauuucagagcugacaaauauggguugcuacuguauuuaauuuuuauuuuugggacaggcucuccuguagcccaagauagguugaaaucugcuauauaaauggggguggucuugaaccucugccuacugauucuccuaccucugccucuugaaugcugaaauugcagccuugcacugccacauagagucuauggauccuggaaaucaaacuuagggcuuugugcaugcagguccagcacucugccaacugugcuaaaucuccaacccguccagccuuuuuugacgucaucucgcagucuuuauuccuauuuaaugcuuagugucucaucuaaaagcaauaugggaggaaccccacacagcuuuuuaugcugagcugugugugucaucuauagaacauuuaaguuauucagaagaaggauaauuaggcuuaaauauaacauucccauauugcauguaauauauacaaauacauauauaucaauguugguguauauguccauagcuguucaucuuuccacacaauuuacuacagccuuuagucacacacacacacacacacacacacacacucaaaauaaccaugcugaaagaugagaaaaggaaggaaaauagagguuauucauccugauguuuuuaacguauguaucuccuacuuagaaauauucagaugcagcuuugguuuauguaguuaauuuuggugguacaauguuuuagaugauggccaacagaaggcuaggaggcaauuguugaagcuguaauuugcagaaguuuaacaauacaaguccauuuucuuuucugaaugugcuauuuauauaauuuguauuuuuaacaaaucuuagaacuagaaugaaaauaguaauuaaucuuaagaguaaaaaaaaaaaaagcuacagcuagagcaaauuuggaaacuaagaaauccucuugguuaggcccgcucaguggaacacucuuguuuccaucacagagcuugcagcugagcagguagcaaaugcucaguuaaugaugagaaguuggccagguggguaccaugucucguucuucccaggaaaaccuacugcacugagaaguagaaguuuaguuguaaagcugagcuaagccaccaacaaagaccagugaagccacacuguccagagcagggcaccugugaaaggaacagaggcagaguugagaauguuugcauggggaugauaagcaagguggaggguuuuuuguaucuugcuugcuuuuaguuccuacagugagcaaacauacuaucuggaagaugauacuuuugugaugcagaguauacuuuuuuuauaagcuuauuuaacuuguucuuaaaacggaguuaaugaauucacaaacuugaacuggugcccauuuguguuuaauagcuuuucguugaguuugcauucuagcaaaauucgcauuaaaauaauauuuuccauaauuuucuaguuuacucaguuauguucuagugcaacacacuuuaaaaaauuaguuuugcucaugugugugcauaugugucaguuuauguguaccacaugcguacagguugucagggagaccagagaguguugguucuggaguuauuagcaaccaugauccuccugauguggguucugggagucagaccugggaccuuuuucugcaagagcagaaugggcuccugacugauaagccaucauagcucuguagccccauauacauuuuuuuaaagucacuauccugugcaaaaagaugcaauugccuaaauguuuuuaguuugucuaccaaacuagaaguacaauauuuuuuaaaaaauuuuaagagaagauuggagucuaauaauaguugcuauauucaugguuguuaguagguuaagcaaugcaccaaacacaauaaacaugguacuuggucuuguccaagacugagggguugccaaagaauguguccucagaugaguuguuaugaagccaugcaaggcagcuuaucugaaguuggguguaguguguauauguauaccacgugugguaaacugaggcagcugguaugugguuuuggagugcauuugugcuuuguguacugacugauggguguacuuugcuguggucaccgcgugguucugugggccaacccacauccacugagugauucuccuucugcucucagacacuugugcuggaacagugcauuucccgaacagcacuguggcagaacggacugcaugugagagagaugagauguaguugugcuuguucuaguugugauaagagcccaguuuggaaccagccuccccaucauuacucauuucgucaagcccugcaugaagcaucccugugugguacuaaacuccaccaugcuuuaguucaugaccuggaacagacacggaacgacauggguuuuguggaggcauucagcucugccagagcauucucccuuggcacguaacuggagaccugccaagcucgucagcuuuccacauccaguucccuuaccagaugggcuuuccagucaagcaaauggccuugaacuugaaauaccaugaaagaaugaacuccaggucccugucugggagucuaaccuuggucauagugcaacucaguucucuuaagugcugccugaaaacccgaaguucaaguagucucaaagaaagcgguucccccguuccuccugaauaucuuaccgcuaauaagaagcaagaguguggcauuugaaauguuuuaugaaaagcuugagaauuuuauaaauaucaaaaauagucacuuaugggaaguauacugcaaagccugugucugaagucauucagaugagcagagguuuugaccaugagauaugccugagauaucuuuccugcuaccugccuaccacuuacaugaccuaagcuaaauuacauuuagcauuaucucccacuuccauuggaggucaccagaagguagggauuuauaaugcugauuuguguggugccugccuugugaguuuugggaaaagugucuuugacuucaauaccacaaaugacugugcuccuacccagcuuuggccuucuguuuuaugggcguaguuagucaugucacugauccuaucuccuuccucuuuauggccacagacauguuugcuuugacccacacauuggaaaaaaaaaaaagacccaaaagaaaaaucacuugccaacaugguaacaugggaaugaaauuucccaccacuguauuugacugaccagcauuuauucaaacaccaagucuggccacauugaacucuuaucuccauggugacuuuuccuuaaacugucuucagucgcuuuagccaacuuccccugcuucauccugcaagaugcaggacuuacaaguccucuggcuugggaaagcaguuugggacgcagcucgggaagccauguaggcuccucgcgagaucuucccuuucgucuccuguacuaccuuccauuccucaaguccuaguacuuucugcccuugcuuuuugaucucaggacaauguauguucuuuccauaaaguguauuuaagccucuuuugagaagagauaaguauaaauaagcaaaaauaggaaaacaacuuucuucaugaagccguuuuauuuuuacguuugccugguaaguucggaagcauuucaguguuuuuccugugaccucuuuuucaguguacuugauucuaguaucauucaagaguucuugguguguguguguguguguguguguguguguguguguguguguguguauuuucucaguuguuaucgugugguuuccuuccugccucccaucccugcuuccuucucuuccuucucucccuccuucaucccuuuucuuaacucucuaguucuuacagagacggauuaaacgugaguuuguuugugcagcuucuccucugacaguuacuacuuagguuuuagggauagagccgugaauaaaauggacaagaauacaugcaguaucauagaucacguaacugucaggaaugggauugaaaaaaaccaagaggggguuucccuuuaaccugagguuaauggguuaagcgucaacgccagaguuucuucugagcagaguuuugaauuaacaauagagugaacugugcagacauguagggagggacacuguggccuagagggacagcagcaagaguaagacaucucucuuuaagagagagcauccugagucuggccugagguaucucuuuuauuuuggauguugccuccaugaagacugucaggagagaggccucuggugucaguaccacauauaacaugcuucuacccagccuuggccuuuugaucugguagcaugggcuuguacccucuggaccauaucugugaacuuauuucaccccuugaaggacacaccuuuccugcugguuuguguucugggccaacucuggucauuugguaaguguuuaguaaauauuugugcaauuaaugacugaacaucaauaguuuuagaagaauagcaagcuucuccacagagaccacuaagccauguccuuacagguguggguaaagccuugucuuugaucuauagucagggccauuaucuauugugccacuggccuacccacaaggucuuuuucuuugauggugauugcagucuuuacacuuagcaagacacaucuacaaauaaucuuugccauccaagaaagggcccgagggucgaugcuagucacuaguggaguggauuaggaguucauucuccaggauuaaccacuuauuggucaugucucagagugugaacacuagucuauguaggcccacugugucuggauuuucuuucugcuauuugucauugcuuaucccaacuucuagcugagaauuugugagcucugaguaagaaccuaauacacacugaagaauaacuaguguucaaacaugcuuauaucuucacauacuuuuauagagcagcauuguauccaccuuggaaaaaauauuauacauucugugauagucuucuaaggacaccgcagaaggagggacuccuggaaggccaaauggguguaaaggccaggccuucgugacacauauaucacaccucccuugcccuaacuccuuaguuuuuuuucccucuuuaugcagagggaaacaggucaggacugguaaggauggagccuuauuuaauuguaaccauuguguucauaauuugugguuacaucaacaaaagaaguuugacaaggauuuucaggauaaauggacucuugauggggugagcagucuccuuuccugucacgugcacuuggcuuccuucuugugugacugguaucagauggagaggaaaggcugcuucagcaugcaugcucuuuuggguuuucuaaauccaccucgaagguggcuuuggcuccauuccuggagacuucaccugguuuucuaaaacacacaugggaauuccuuccuuagaggaauccuugcuugguuaugguaagacauugguauuuuacaauuauaccuuuuccauccccauguaaguaugcagcuugucagcccauuccugugaggagccgcccucacauuugccauuauaagauggcacugacagcuguguucuaagugguaaacauagucugcacacaugcaggggcaguuuucccaccauguguucugccuuucccgugaugacaacugggccgaugggcugcagccaaucagggaguaauacguccuagguggaggauaauucuccuuaaaaagggaugggguuucgccauuugcuugcuugcucucuugcacucuggcuccugaagauguaagcaauaaagcuuugccgcagaagauucugguuuguugcgucuuuccuggccggucgugagaacgcgucuaauaacaauuggugccgaauuccgggacgagaaaaaaaaacucgggacuggcgcaaggaagaucccucauuccagaaccagaacugcgggucgcgguaauaaagguucccguaaagcagacuguuaagaaggauucaacuguaugaauucagaacuuuucagcuggggaacgagaguaccagugaguacagcuuuacgagguaagucugaucuugaacuuucuaaggaaauucaagacagucuaucagaaguaaaguggaauauguuuggccuugaauuuuuucugguguuaggagcccuuuuguuccuuuucacauguuaucaagugguuaagauagggaggauucuagaggaaauucaggacaagcuaucagaaguaaagcggggagaaagaguaggagcaaagaggaaauaugguacacaaaauaaguauacaggccuuuccaagggucuugaacccgaggaaaaguuaagguuagguaggaauaccuggagagagauuagaagaaaaagaggaaaaagggaaaagaagaaagaucaauuagcggaggucucuaggaaaaggagccugugcucaucgcuggaugagcucaggaagccagcucuuaguagcucugaagcagaugaagaauucuccucugaggaaacagacugggaggaagaagcagcucauuaugagaaaaaaggguaccagccagguaaagugcuagcuaaucaguuaaggaagccaaaagcggcuggcgaaggccaguuugcugauuggccucagggcagucggcuucaagguccgcccuaugcggaguccccgcccugcguagugcgucagcaaugcgcagagagaugcgcagagaggcagugcgcagagaggcagugcgcagacucauucauucccagagaggaacaaaggaaaauacaacaggcauuuccggucuuugaaggagccgagggugggcguguccacgcuccgguagcguauauacagauuaaagagcuugccgagucgguccguaacuauggagucagugcuaauuucacuauagcacaaguggaaaggcuugcgaaucacgcuaugacuccuggugauuggcagacgguaguaaaagcuguagcccccaguaugggaauguaucuugaguggaaagccuuguggcaggacuccugccagacgcaggcaagggccaaugccaccaugaaaggggaucagagaacguggacuuuugaauuacuuacaggucagggacaacacgcugcuaaccagacaaauuaucauuggggagcauaugcucagaucucagcugcugcuguuaaggcauggaaagcacuaccuaagaagggagaggcaagugggcaguugaccaagauuacucaaggugcacaggaauccuucucagauuuuguggccagaaugacagaggcagcagagcguauuuuuggagagucagagcaagcugcgccucugauaaaacagcuaaucuaugagcaagccacaaaggagugccgagcggccauagccccaagaaagaacaaaggcuuacaagacuggcucagggucugucgagagcuugggggaccucucagcaaugcagguuuagcggcugccauccuucaaucccaaaaccgcuccaugggcagaaauaaucagaggacauguuuuaacugcggaaagccugggcauuuuaagaaagauugcagagcuccagauaaacagggagggacucucacucuuugcucuaaguguggcaaggguuaucauagagcugaccagugucgcucugugagggauauaaagggcagaauucuucccccaccugauagucaaucagcuuaugugccaaaaaacgggucaucgggcccucggucccagggcccucaaagauaugggaaccgguuugucaggacccaggaagcagucagagaggcgacccaggaagacccacaaggguggaccugcgugccgccuccgacuuccuauuaaugccucaaaugaguauucagccggugccgguggagccuauaccauccuugcccccuggaaccaugggccuuauucucggccgggguucacucaccuugcagggcuuaguaguccacccuggaguuauggauugucaacauuccccuaaaauacagguccugugcucaagcccuaaaggcguuuuuucuauuaguaaaggagauaggauagcucagcugcugcuccucccugauaauaccagggaaaaaucugcaggaccugagauaaagaaaaugggcuccucaggaaaugauucugccuauuugguuguaucuuuaaaugauagaccuaagcuccgccuuaagauuaauggaaaagaguuugaaggcauccuugauaccggagcagauaaaaguauaauuucuacacauugguggcccaaagcauggcccaccacagagucaucucauucauuacagggccuaggauaucaaucaugucccacuauaagcuccguugccuugacgugggaauccucugaaggacagcaagggaaauucauaccuuaugugcucccacucccgguuaaccucuggggaagggauauuaugcagcauuugggccuuauuuuguccaaugaaaacgccccaucgggaggguauucaacuaaagcaaaaaauaucauggcaaagauggguuauaaagaaggaaaaggguuaggacaucaagaacagggaaggauagagcccaucucaccuaauggaaaccaagacagacagggucuggguuuuccuuagcggccauuggggcagcacgacccauaccauggaaaacaggggacccaguguggguuccucaauggcaccuauccucugaaaaacuagaagcugugauucaacugguagaggaacaauuaaaacuaggccauauugagcccucuaccucaccuuggaauacuccaauuuuuguaauuaagaaaaagucaggaaaguggagacugcuccaugaccucagagccauuaaugagcaaaugaacuuauuuggcccaguacagagaggucucaugcugguuaaucaacucauagaucuuguccagauacaacuagauguauuaugacaaauaacucagcaggguugugaacaaaaguuuccgggauuguguguuauuuccauucaguauguuaaauuuacuagggcagcuaauuugucaaaaagucuuuuucaguauauguuacagaauuggauggcugaauuugaacagacccuucgggaauugagacuugccaucauucaggucaacuccacgcgcuuggaccugucccugaccaaaggauuacccaauuggaucuccucagcauuuuccuucuuuaaagaauggaugggggugggauuauguggagauacacuuugcuguggauuaguguugcuucuuugguuggucuguaagcuuaaggcccaaacuaggagagacaaggugguuauugcccaggcgcuugcagcucuagaacauggugcucccccugauauaugguuaucuaugcuuaggcaauaggucgcuggccacucagcucuuauauucccaugaggcuagucucauugcacgggauagagugagugugcuucagcagcccgagagaguugcacggcuaagcacugcaauggaaaggcucugcggcacauaugagccuauucuagggagacaugucaucuuucaagaagguugaguguucaaguguccuucccccaggaaaaacaacacgggaccagaccaggaccccucugggugaugagccugggaggagguuauguguacggcuccuuuaccugcacacuggggauuugaccucuaucuccacucucauuaauauggguggccuauugcucuuauuaaaagaaaagggggaucugugaggagccgcccucacauuugccauuauaagauggcacugacagcuguguucuaagugguaaacauagucugcacacaugcaggggcaguuuucccaccauguguucugccuuucccgugaugacaacugggccgaugggcugcagccaaucagggaguaauacguccuagguggaggauaauucuccuuaaaaagggaugggguuucgccauuugcuugcuugcucucuugcacucuggcuccugaagauguaagcaauaaagcuuugccgcagaagauucugguuuguugcgucuuuccuggccggucgugagaacgcgucuaauaacacauucccucacauucuaagucagagaugcuagaaauucuauaacuccuucccucuguuccugugucaggaacagauuccucuccuugcccuagaacacuggauuuucuucuucuucuucuucuucuucuucuucuucuucuucuucuucuucuucuucuucuucuucuucuucgucgucgucgucgucgucgucgucuccuccuccuccuccuccuccuccuccuccuccuccucuuccuccuccuccuccuccuccuccuccuccuccuccugaugaaaucauacucauuugcuucccugcuuuuuuaggaacacaaauuuaaauagggaggaaggguggugaaugaacaacagucacuugguuggaggggcucuguggaauccuuacugccccuugcauguaugugcucuguagcaagggggcaugguguuucucaggucaaguucauacagaugaaagagagaaguggauaaccuaccuuucuggggaagaugaaauggcugugucuucucauuacuucauuuuuuccccuaacucacucugugacaauauugcuguggcagauauuggcuggccauggaacauuugaaagagcaaaggucucaugaauggucugugugucaccauagcugcagagucaaaacaaaucauccuucauguguuuccugaagcacuccagaauggauuccagcuuuggugucagcccuuugaucacacuguuaacugaaaacaaacuauuacggaaaacauagccguaaagaaacauugaacagacauuugugucauucuguuuucucaguuccugugguaugcucagaugguaacgcacagugauaacugaguguggaaaguccuucuaaaaaauucauguucuugagucugcuuacagauaugauguuacugacauaaucaaugacaucucauuagcuuuuaauagcgaaauccauucucacuaaagaguagauacugguauuuaaaaagaacuugucauggauaccccagagacucauaauuccccuuuuuuuguacuguucaccucacaccuuaguacugaugagaguaaguauuagggugcuaguuuacaaggagaguauuugggagucuccauuuaccuggaaacauucugggaaaugguccuggugaauugccucuggaaguaggagggaagagguaguuuuggugagaccaugccagccucagccuucggugaugaagcugaugauggugaugguguuuuuaauggugaaggcgaugguguaucagauuccuauguuugcaugucugucccaagugggugugagacauuacucccugggccacggcauagcuuguggaugagccuguggaugagacuguucuuauuuccauguuguauaugaggaaacagagggguugaauaguuucccuuugggggcauagcucaugaggggagaggagcuugcguaugaaguuccuuuuaucugcuccucaccauauccuuuugucuguggccuggaaccaauuucucuguuccacucguaucuuuugccuggagcucacuugcuggaauguucaucaaagguccaagguccuuccaucuuagccucagugcauagcucaguuuucaaaccgugucuaccuuuugaauuccuggcaguauacugucacuauucaaguagucugggggauacuaacuuccacugcaaauauucagugcguuugcccugauuaugcaugcaugaguuuucucuggaaagugugguuuuucggugagucgcagagaaguaucugauccgagaguugaagauacuguugcugauaacucucacaaauggguacccagagccaaggaacauguccucuuguugguucuuuuugugcauggcuuuaacaaugcuauguuuuuugagugucuggagagauggauauauuuacuuguagauugugauuuaaggaacagaggguaugaauucgacugugccuuggguagaaaacugucucaugaguaaauucucaaaacuacauuuucuucacugagaaaaggacaucauaacaauaugagaguuaaggcacucuuauuggagauuaaaaugaagcauauaugugcaugcuaagugugaugauccauugcauagcuuccauaagcaacuaaacucccuacuacugcuucugauuaagugucuuugaaaaggcuggaaagaagagguucucagaauuuccguuggauugucagagaguuacugaaggcuucagagcauaagacauuuuucuguuacucuugagucuuaaaggcuuugagccacuguugguguagucauggauacagggagguaugacccugaaaugucauucucuuuuccuguggccaugacccugggccuaccauggcccaggcuugacagaaggauacccaaaaacgccaucucauagaaacguugugaucugggcacucugcccccgaggagucagacauaugcuuuuuauguuuaaaucaacagaaaaaagugcagcuguagccacugcucugcauaauuguugaaguagcccuuuuuguaggauagucacagaguccccaagugucagguaguccuccuguguaucacagguguguauauuaggucagauaaaagucagcagccacugagcgaugucacuucugacacagaaaugaugaaacuguauauaaaucagggcaugagauugugguaauucagccacaagggucaugcacggcaagaggaggccacguaaaagcugccuccuucgaugcuucugaacuccaccccugugaugagccauaucacacucaacacagaaaaugucacuuagagucucugaacagaauacauugcaugcugaguguuacugauccugggucagcuaggccuuuccuguaguuuuuguguccaucauuucauuuaucauuacuaacuaucaccuugguugagucacuugcaaacacuccucccccgagacccccgguauucaagaacagguagcacauucaugacugcuccagacuagaagccaucccgaaugcacauucccuuguaaaugaucagccagauaugguuccagggagaucuaauuagccauuaaaagcaauagacucuggauaucuguacccuuguggggaguucucaaaucuauuugccaaggccagaaacgugauuccagaggcuguauauaugcuggcuagagaaguuuguagagcacuuggguagcaaagccucagguuuguuccccagcaccaccuaaaccaagugcagagguucacaccuguaauuccccaacucagaacuugaaggcagcaggauggguaguucaaaaucauccucagcucuggaaacuaauaaaugguuucugggagauagugcucaggagagacuugacuaccucugggcagcaccagggagugauggucccauaccuuccuguggggaugauguuuacgggacuauacaucccgacuuuauuagaaccacacacaaaggaaaggcaaauuugaaugacuaaagguggcaauuaaauaauacuaauuggaugaugguagcuaugcaauaugcuccugaggaaaugcuuuggcaguaugauacaugagauuuaaauucuauaacuauuguguaaaugccagaagguauuugcugcuuaguugcaguaaugcuuugcuuccugagaaccuuagaggaaauccccagcccaggaccuguauggcgucucacucacugucuuuuaauaaauaagcccaagaagauaaaaguuaacguagaagguuauaagucucugaugagcaugggauauuggaggaaaacagaucaguuacuaguaggagguuauugcugagaaagugggaaggguuuguccaccaagaagaaacauuagaggagaaagagaucaauuaaucuuuggagguuauggcucaggaagugaggaagauucgccaaggaaugaucuugagggauagauuaauuuuaaaguauuuuugagaggacuuuuaguugaagaguuacauucuauuaaaacauuuuucaauguuuaaauuuuauuuuaugaguauaaguguuuccuugcauauaugccugugcauuacauaugagccccuggaggccagaagaggguauaaguccucuggaacuggaguuacagacagcuggaagcuaccauguggguucuaggaauugaacuugugucuuccacaagagcagcaauuggccuuaguuacugagccaucccuucagccugaaccauaguaucuuacaaaguaaucaaauauuguauucacuuccugauaaauuuucagcaaguuaucagugcccacucugagacagaggauagauuggcacccuuuuguaacccuucauuacuccuuacucuaaauaccuacacucuccucauuucuuguguguguguguguguguguguguguguguguguauguguguguguguguguguguguuguauuuacauguucauauggauggguauacacauguguguaggugcaugucaggugucuuccuuaauuguucccuacuuuauuucuugagacaggaucgcucaguaaaccuggagcucauugauuuggcuugacugggcuccaaaaaucuacuucugucugcccuaugucucugggugcuauagaugaagguccauauugucugugcccagcuuuuuuaugugugugcuggagaugugaacucagguucucaugugcugacuucuaacaacauuuuaaugcuugucuaaguuuuauuuaacuauguaaaucaaagguuagcccaaguuuuauuuaacuauaacaaucagaucaugcagucuguacuuccacaugugaacuauuuuguucaucuguauguaaaugaauucaccuagucacacagcaacuagagcuaucugaaaggagggagccuuaauugagaaaaugccuccagaagaucuaguuguaaagcacuuucuuaauuagugaacaaugagggagggcccagcccaugguuuguggugcuauuccuauuucuggguucuauaguaaaucaggcugggcaagccagggaacaagccacuauaauauguagcaccccuccauggccucugcaucaguuccugccuccagguaacugcccuguuugagguccugucuugacuuucuucagugaugaacagcaauauggaaguauaugccagagaaacccuuuccuccccagcuugcuuucuggucacagaguuucacugcagcaacagaaauccaaacuaagacaugacgguaauauuaauccauacucugguggcauugccaugugugggucccaguaucgauggguucuguaccgugcugugguuuuguaucuuuccacucuuguccagcuuggguagauaacaagaaccuuuuuggaaaaggcuuugagugaauucacacccucagcggggugguccuauugcucuguuccucacuuguacugguuagcauaucuaucuuacuuugcugggcaguguggagacacuggggcagaaagagagugugaauauaugaaggguguuccggacaagagagcgaccucugugagcaugcacagugagcacauacagcuagacuuugagcaugugugagcugcccauguugccugggaucauuaagucuagggagguagguuggcccuugauuggcaggcaaaauaaaacauuugaaauucuuucacuauuuauuagugagccauuaauugccugagagcagcaaaccccugccuaggaaagguucucuaggcacaggcagcgcaguucagccguccagguuagagcggaaucgcguuagaauaacuaagaaaucgaggaaacacaagguuuugguuauugccagauaggucugcugcuccuugggggaugagguacauuugacaugugguaucuuagguagcuauaugaugccacuaguguccuuuaacauuucuuuagugacugacucuugcuaucucauuuucucucuauccuuacuccucuuucuggauuaaauauauuuuucuccuuccuuccuuccuuccuuccuuccuuccuuccuuccuuccuuccucucucccuuccuccuucccucuuuuuuuuuuuuuuuuuuaccuuuucuuuaauagggucucacacuguaguccaagcuggccuggaauucaguauuuaaccuugguugccaugaacuccuagccaucuuccugcuuuagccucuggagagaugugagacagacaacacaccugucuuauuauucaauguaucuuacauuuagaaaaacauugaagguccauccaucuacuaaagaauaaugaacugacuacuugugcacaugccauccuccuuaaauguagaacacacucuccacugaguuaaccucccccuugaacaguguccugcccgcuccuuugcuuuuuauuauggucuacaucaguggguccaguccuaaaccuugccuuggccuuuugccuguuggaaucacauaacagugcuaugugauuuccuuuucucauucagcauuuguuuggacuauaaagaguacauauggcuguggcucaccagugugucgugguccacuguauggauaguucucaguuuauugacccaaucccuccucaccuuuaagugcugacacacugacccauauauuguggcacgugugguagaauuguccguucaugcucugugucccauaaacugaaaaagcugcccauaagcucauuaaaacuuuugguuaauaauuuaauguuuacgaagacuuggaaggacuuuguguucugugugggagacgccuccccucucuccucccccuuuccauccuccuucucguaugucuggguaugguaugcauugggugcaugagugcucacguuauauaggcacagaugguauguauauguaugagugcaugugugcaugcacacauaugcaagccuuggccugauccuggggagucuuccugaucccucugugccuuguucauuuaggcagcuucucagcgaacucagggcucaccugggcagcuagucuagagaacuugcuucagaggcuccagaaccuugccucuugauauccauaugggcuggcauggagcagauccuggauuucgcucugguguggcaaguacuuuggcugcugagccaccucagcccagacauguuuucccauguguuuucugggagacuggugucugcauugcagcucagcuggcagcgucucuggccuccuccauucguugguccaauagcauucccucuccauuugaaaaacaaaaauagaaaacuguuccaaggccuuuguccccagcgucuguaccuucuguaccuacacaggcaaucuugggcuuauuucucugcuucaucccgaccccaggugggugacugugagugaggauauuuccuguugucuuuggcggcgccuuuuuuccuguccuggugaucagcccugcucuguuacaagugucuguugcuguguuuucauggaucacaggcuucccuuuuucugaaugccuuccaucuguguucacuuucugguucuggugagacuacacacuuauuaguagucauaaaaagcaaguaauuuagagaaaacaaauuguauacuuuuuagacuggucagcuuaguaggcaauaauaaauacaugguaguaaaguuaaaaaaugaugagcuauaugauguucauauuugaaaugcacauuuaaaacauuuacuuuuauguguaugggguuuuacccacacauauaccuguauagcauuguguauugcccggcgccugaagaggccagaagagggaauuggguucuugagucuggacauacagaccauuguaaaucucaugcaguugcugagaaucaaauguagguccucuggaacaggagccagugcucuuagcuacagagccaucucugugccugugaaguauauauacaucuuauagcacugauucuuugcuauccauuuggaucguguuccagaaagcacugugguauguccaugguucacaggcuguguguaggcaaagauugcuauggauguaguccgaccccagaacuuauuguaaagauuuuaauuuucaaauuaugugcauauguauaugugugggcgugugcacauaaguacggggcacccagaagaggccuuuggaauaccaggaacuggaauuugaggaagcugugaucuucucugcauggaaaauggugugugggaauucuaggaaccaaaugaguucucugcaagggcgaauaugcucuuaauugcuaagauaucuuucaaacucccaaucauaaauuacauuaaaguauucaguggauuuuuuaaaacuugauugugugguucuugagcacagaauuuguacauaacaauauuauauuucaguguugaaggcugggcaugccuugguaagacaguucuaccagcaaaauaagauaaaccauguaaauuaaaaauauauuuaauauuacccagcucuuuuaaacuuugugugugaauuccccacaccccuuacacccucaguuaacaggaagccuguccaugaaccccaaaguauugcaaaguuagcuccauguaguguaucacuagcagggaauuuguuucagagaauaccuugugauaauucaucaugaaguuagaaggauucccaccaaacccaaacccagccauuaacuaaaugugugucucauaaggaaacauaggcagugucagcagagggauccucaaagacuaaagcauguccucuagccucaccugacguucuguucuacaggcuuggggucuucuccucagggcagaggcccuguuugcaggcucugucagcaccacugccugucacuuccauugugaaguucucaguccuccuuggcaggacccuacacuuccagcauggaauccuaucugcaagucacacucauuuuccacagugagugaaagagagauuagggcuaagcuugccugcgaccgugucagagcccuguauggcucuguuuuaucacacugaaauucuucauagcuguuggcgucccacuacugugcaggaggucacuauuucugggcuguguuuaaucuuguuuccccugaaggauucuggcacauucuucucucugauugcuucucagacuccaacuauuccccugcuaaguuccuugcuuuugcuucuagaaacaauguagugcuucaaauacugaacauaauuugagggaguguuauauaguguuuagacacaagcacaaguccuuguaaagcaaauauaaugaaauugaagaaaauguucagauaagguauguggucugggacacccagaggccugagcuuucugccuaacaaugggcaaguguugaaaggcuguaacacauuagcaucggagauguccugagaugaaagaauucugaaaggcgucuuucagccugugacuccaaggcuacuuacuguggagucaguguguccggauucgagaucauguugaaccgcgcucuuaggagcccucacucaugacugucuuugcagagagacucuguuaagcuccaacuuuccgaagaccaugcuuaucugagaacccaucucaaaucauugauuuucucccacuuuuccccauuaacguguguaaacuguguccuagguacagggacuuuuuucauauacauguaaaaccuuacuuauuuauuucugugugucuuuguggcacagcaugcaugugggggucaggaggcaacuugcaggaauccauugucuuuuuuguaccacgugggucccaggacugaauuuuggugcuugagggaagaaagcuccuucaccugccgagcaauucagcuuugcuuuauauauauaaaaaaaaaaucauugcaauuucacguuuucccaggccccuuuaaagcaggcgauuuaagggcaguguuucuucuuaguuucugucuaguaacugccauuauuuuaacucuuguucgcuaugaauauucaggaaggucugccuaacucuugugugugguuuuacaaagucagauccucgccacaggugacagugaaugcaccauguuaaugaauuaaucauugaacgcacugcccagugggugcugagugucucccugguguggaacuguaguucauggguggagugguaaacagaacagauaugguccaugccuucacggaaugcagaaauccaguggggccucgguuagggucaggaaugaagggaguccagccccaggucuaauuuuagaacugcuucacucuuuugauccuugaguggcuuuuguaaacgugaaacagaggacuguggguuguggagcggcacagcccagcucugugcuccauucauguguucaguuuuggaaagucuccuacguccuguuccucgcuuccuuuuaaguaaagagauuaaauccucgugaggugcgaucugcaaaugcgagguacaguguggcaguaugcugaggaauucuccacaucucugacucuucuccugcuuaucuuuaagaugaaccagagauauaaucucacuuagccacccucuccccccguuuuccccauuuccuaacaacacuacaagaaaugaugaccagacccaauauuaggaagcugaacucuggguuaauaacaauaucauuguagcuaguaacaauuauagacugugcaauucccaagcuaucuguuuaaaucaauaaaugauuaauauuagcacuaaacauugcuguuaagacucuaauguccauggcauaauucugacauauaccaggcauaucaacuagaaccuaagcuguagcgggugcuaaaguauuuguugagccuaugaguuuugauaagaauauuuuuauuuuucuaccucuuauucaugauuuugcuauuauuauuuaaauacaauucauuguuuuaauauuggaagccagauaaacuuggauuaauauaauuauuauuuccauauccccagcuuggucuguaguaucugaacauuaucagugucuaauaacuauucauaggagagacggacauaauaacuauucauaggagagauggacauaauaacuauucauaggagagacggacagcuuugcucggcacuagaugaagagcauaagguuuaauauuuauaacaaagaugcauuuuuccuuucugacuuuucauggcacuacuguuuaaaauuauaacuuuuacuaucaacauaaauauauggcuugauuauagcagggcccccuagagugugaauuagguacagaaagcuaauauguauccaguuuauuaugaaugauuggauuuaaucaacagacaggaaggauuucugugcaaauauuauuuuucccaauuuaaauccuguuugcucagcauaacugaagaagaugucauuaguauaggagugagagagagucuucgagcugcuucaaguacuuggggaaauuugacgaguaggacauauucggagugaggugaucuaccaaaugcaauccagaguggugcuuugaccaguuuugaaucauacuaauuuugcuauuuaagacaagauuuuccacuugacucccaguuuuauguucauauaauaaaaacuauaaauuauaaacauaacugacacacagaaccagagcagaaggcuucugcuagaauuuaguuggcagcggagaauguugugggucuuacguauccacuagaauuauugaaucucacacacacaucuaguccuuucuuuacuuuuauuuuauuuuuauguguauaaagguuuugcauacacauguguauuugcucuaaauugucugugaugcccacggcaccuagaaaagggcgcugaaucugcaaaagcagaguuauggauggcugugagcuucuaugugcauacugaggaccuaagagugguuccuuugcaagagcacgggguguuccugacuacuuagcuaucucucuguccucacuggcccuuuccugaacuuacaaauacuuuacaauagucauuucaaauauuagguuuaagaaacaucuuacguuuugucucugaauaacaaucagagacaauaauaaucuuucuuuguucuagaauucaaaguucuuucuuagcauaacaccggcuuugcauucugaguuccuguuccucaggcagcacugaguggaugcuauuuuccaggccccugcuaaauacuuuuccugccauaucucaucucaguaugacauuuaucuccaggaauuaaaugacuugcccagggaaagccaggcugggggcagucaugcucugggucugcauugaguaagcauacagucuauucuucauuggcaaaaugaugcugaauuugaguccagcugagagacacugacuaauguguuuauaagacggugggcugcuaagagauuugcugcuuaguuccugaccacacaucuuguaacaacuggugcuuuugcaauuuaguggcuuccagucaucaucuacuguaccaucaugaugugugagacccauucccucucuacucaccgcucaacucuuggcacgugaauaugaucuucuacagugaacaguggugguuguaucguugccagaacaguguaggugauauuacaugauuuggauggugcgggucaggcauuccacauggccuuuugauucagccaagaaacacagucaacaugagucugaugaggcugcugcuaaaauuucauggcacgcugcuuuauaguaaauggaaaggaacacccaaaucacuaauggacucccuuguguuacucccccugacauguuacucccauugguguaugucaggcgcugugcuucuacacaucuuacaaggcuggaggucaguucacaggcagcaucaccacagacccugaggaauguauugugccccaguauuugauguccucgcugcugcuccacccugguuuuaccguaccaccuucaauauauugaagcuuuaccugauagagauuauuuggcaugcagcuuguaaugcauagaccaggaaaccuagcuggccaggcuauuuuccuucuuucucuccaucucuuuccagcgccucuuguagauuauauaguacuuagcagcauuucugccacugaucuccuggugugucacugagagaaggggacagaggaagguguguuuauuuuccucagcaaccaagaccauagccagggcaucuugugaagucaccuuugauagcugaauauuaggguccuuaaagacacugcaguaucugcgcucuuguuucgaagggacugcugugcuagaugguacugauggagggacuccccccauuuuagccccgcugcccuuaaaagguggccagaggcauucuguguuuucuuuuucucccuguuuccucucuuuucacugaucacacacguguguguguguguguguguguguguguguguguguguguguguuuccuuuccucagucuacucauugccucaaacucaugaucuuccugccccagccuccagugcugggauuauaggcagacuuuuuuuuuuuuuuaaucauuucuuuaaagcugcuaaagcugcuaacaguaacagagaagcccaugguuuuucuuuuuagugagucaagagucagaggaagguucaccauucgaagacuguacuguaacgucagacagugaaucacugaccccuucacagcagcuuccugcuucuacuuaucccguaaggaaagcgaaggacauuuuaucaaauuucucauauuaucaaaacagcacaaucaugccagggcccccaacuuccuguugucucagccucucgacuuacacagguugugaugugcuagcuacaaauaccuauggccuacuaauagcagauggccgacccgucacugacuuugacaccuggacagggacuucuuuugaagugaacccuaggagacagaaggagaucauuggagcuagggaauuaaucugauguauugauuacuaaagaaaagagccaaauuaauauuuuaaauauuuaucccuucauuaccugcuuaaaaguucccugcagacacacugugagaccccugugcaccccuaugcauugccguuuuaugcuuaggacagauguuuuuauaaacauuaauuuuucccccuagcuguuugcauaagcauccucuaccgaauugcuuaauaauguugggguaucaguacgucagauuuaccugcaguaaccuaauucucucuggcucaucuucucagccuugaagggcuucucugggugccagggacagagagcuagcugucuuccagaggagguuguuauaucauugaggcagcaaggucugcucuuggauggagaaagaaauagaaacaagauagggaaagauaaacgugauggagugcuauugagcagugauuucugcagagagguagucauuaaaaauuuccucuagucaugcugggacacuuugaauagaacugcaguuccagcuccugaagcguuguucuccagucugucaucuacaaaaagaagcugugcugagccccuuuaaagcaucuacacaagcauauacauguguguccugcuuacagcacugcguuccuuuuuaauuaguuaaaugccuucauuagaucauacuuaauacaucucugcuuacugguuuucauuucugucagccauuuguccagccuuccuccaaucagucuagaaaaaauuuauccagcacuuguuauuugccagguacugagaauaaaauagauauguauaaauacauaugaauaaaauaaaugccaaggauucugccugcuaaaacaauuacaauuuugacuaaguguuaucaaaggaagaagucagcaccauuugcugagacaauuuaacccagaaguggguguuucugccuuaggaagaauggucagcgaagacuugccagagggagagagaccuacagaaacucuaaucccagagcucuggaggcacagguggcucagaucucuguaaguuacgggauaaucagggcuguguagagagacacugucucaauaaaacaaaacaaaacaaaacaaaacaaaacaagaacaaauuucauauccaagggggaaggaaccaaccuggguggaguacuaagaagggggcggggaguguggaguacucugggcauuccucuucuacaugucucuuugauagagugguuugugucagccauggagaacagagugucuccagucuucauuucagucuugcacaauggcacaaugugugacucaguagacguucaagguggagggcccaugggaaggauuucccagcauacaagcuucaugguguuaggcaagaaagauacguugaugacuauugaaggugcuuuuugaauuuuguuaccacauucuuggaugaccuaaggauuuugucaauauucaaaacauauuaugggaauuuguagcggauacuuuacagaguuaaaaguuacgagcaaguuuuauucagcaguuaaagagagcagcuuacguucuucagcauuuuccugccuucucuagagaugacuuauacagaauguauuauacaggacuacaucuacauuguauuuauuuaauuuuuaaaaauuuggucuggaugggugucuugcuugcauguauguucaggcaccacuugaaugccugguacccacggaggccagaggagggugucagauccccuggggcuagaguuacagauggaugugacucucuuuacuauguuagugcugagaaucaaaccuggguccuuuagaagagcugccagugagugcucuuaacuguugagcuaccucucuaaccucuaucuauaguauauuauauaucaaugguuccaguguugaacucuaaagaugcccuucugcaaauagaguauuaaggcagacccuugaagagagagucucauugauuuaucuuaaggguaugauguaaguagaaggugccaugaguucuuuugauacagacacugauuugagagcaauuggcuaggguaacaacucgguguuuguagaugauccaguaagucccacauuguguacaauagguagucaugcuggggaggucauuaaaaagggcaaugacuuucaggagaaagagguguucuuuggggauagugaucauuuaaucuccaaauaaaauaagaaucccaagcuuugauaaaggcauaacuuugcuuuucuugagauauaguuuagacagguuagcaagugaagacucuuaucucgucucuuuagugauuggauuuuuccuuccgccaagaucccaguuuagcucccuaggaaaagguagcugucacguggaucuuugaguguuuuagauuccguuuuagcuaaggcccuguuuuugaaaggucaccaagcuuucugaugacucuaguugauuuacuacaauuuaggacaaggagaaauaacucuuauuugaaaugaauugggcaguaauuuuauucugcuuuuuuuuuuuuuuuuugguuuuacccacuccacauacauacuuucaacucauuuuuuaaauaugguuuucaaguaaauguuacauguguguacaugcauguacacucacucauaugcauguacaaauguguauaaacucaggacauaaauacagauuauauaaauguaucgaugaaggugcugacgagauuugcuuauuuaucuguggggugggaaagauggcucaguaaugaagggugugcacuguucuggcaagagauucaaauuugucuuccagcacucacauaaaguggcucucaacugccuguaacuccagguauagggguccaauaccuucuucugggcucugcaguuaucugcauucauguguaugggugcauacacauaaacaugcauacacauaauaugaauaaaacuuuacuuuuauuuguguguguauuuguguaaguguauaugcccacgugugcacauaugugcagaagucacaaaaugacauugaguacuauccucuaucacuguauauuccuuucgagacaaaguuucuccuuaaaucugaggcucguguuuucccaucaaugcugaaagccagcaaggcccagagauccuccugucuccagggaccuuggagcucuaaucacagguguccagaagucucugggcuuguuagcuuggugcugggacccaaacugguccucaugauuguguuucaagcacucuuuaaaaaaauaauauuuacuacuguauuuaaucccuccauguguuuaucugucucucucuguguuugcacacaugcaugugugugcagacacauaugugacacaacauacauguggcgguaagaggacacuuucggggauccauuucugguucuguagagugaacuccagacuagcugguccgugaacuuccagccacuucugucuaugcuucccgucuucccauaguggugcuagaaauacugaugucugccauuguaucuggacuuuuauguggcuucagcgauugaacuuaggccaucaagcuugggcagcaaauacuuuuuaaaaucaguaucuuacucuguaacccuggcuggccaggauggaacucaccgcggagaucaggcuggccuugaacucacaagacccaccuacuucugccugcugaguucuggaauuaaaggugugcaucaccacacccagcuugccagguuucacucacugaguuauaugcucagcagauagcaaguccuccuucauuacugagucuucuuuccagccccuaagacauuaugguuucauuucaauaaaucacugacagucaaaccaugggcuauucaucccaagacaauuacugaauaauuauuagggugguggcuugugagauguccuuguauuggggauauuugcaugggugauauguagauaauggcacauaugcaccuucagcucaaccuuugguccauuccuguguccaugaaguuucuuugagagcauuaguaccauagaaaucuuuguaagauaccauaaaugaacuauacacguguccuuaaacaguaauuuuauuuagacauauauggaaguaacuaaagggaaugagucuuugaggacaguggguugacuaaaaugaaaagucagaccaggcugaaccaaccagggaagcauuuagaguuguguuguaguaagugccuggaauugaccccauggcuuucauggucaauguuuuagagccaauggaagggacuagccuuuuuguuguuguuguuguuguggguaaucauuaguaagucacacuuuuagacauuaaacaaugaaauaacuuaacauagcuuaagcuaguauccaagcgggauagagucugacuggauccucugaaagcacaacccuucacagagcuucaccugcuaagguuuaccuccucuuacugucuugcaucucuuucuccauauuuucucucacucuuuucuguucccuggguucucuaggugggucagcguugacccaaaauaggcacugcugaccacagucagaacuguacaggauauuuuccuauugauuuuuuuuaaugggucacaacgaccaugaacacguuggcugcauuaucuuacuccugucuuaggucagcaccgagacugccaauuaucccuucuccuuugacuggugaggaaacggguagaaaaaguucagugccuuuacacaagucucugaauuaguaaauggugguaucuaaacguggauucuugaacaccaacaaugaagcuguguagggcugcuucagaagaggagaggcauagcuucuuaguuaucuucuuaccguacccagggaaguuccugcauguagaaagaaccuaguaacuuauguaugaauacaacuauucaccaggggugugguacaauuuaauuuuuucugucuuucuaauuacuguccacuagcuuuaccaaaauauguaugcaccuuucuuggcuuuucccuaauuuggcauuaucuuucuuaacuucauugggcuacuauaaccuccuacacugggacuacuguaguagcuuauauuggcugucuucucauugguucucuacauagcaaccaaauauaaaaucccaccgugagcucaucaguccuccauugacaacuuuuuggugauuucauucuuauccagggacuaaaucagugacaccucucacuggcuugacagcucuggcauggucuggucuggacaccucuuggguuucauacauaucaacgauugccccucguucuacguucagcaacuuuuccugcuaacucucccccuucagacuuuuacauguauuaucacaacuaaauggaagacucuucuacaucccacuccccagcuccagccucagcccagagauucuugccuagggaaaaccccagcugaccucauguaacuguuuucaucuccuuguaguaacuuccauauaaguaaucauggacugauaggauucuuuaauauguguuucccacugggcuauaacaucuuaagaauuuauacaguaauuaaacugguguagcuauucaguaaguauuuaucaagcaggagaguagacaaaaauuaaaaaaaaaaaugaacauggagcauacaguuucuuuggcuaaacucccuggcugacuauuuucuauuauuggaggcucauuuacagaauauaauuuuauuacauuguagaauugugauguauagaaacagcaagcuuuucuauucaauuaguuuggagauaaucucugagacacagaaaggcaaagucacuugcccgggggacacagcuagucagugucagaugucuuuguugugaccuuugaauuguuacagggagaaccuggcucuuuucagaacucugucaggcagcucugguguguugagccuguagcauaaauauuugauaauauugauguugucaugucugcauuuuaaaguguuuucucuuugagaacacguauuacucuuuuuuuuuuuccuucuuguauacugauguacucagaauugaucagauggcagucuaaaauacacaggcguuuggucuaaagauuuguguguccugaaggagacugucaccaguagaagcagcuuguguguucccuuuaccaggcugaggucagcacugcccucccucuacucugggguagguagaagggugaaaaaaagccaugugcaucaauagccuauuaguuguagaaugugcucuguguccagcaaccaaaacuguguguaugguuucaaacuagacagagauucgugcuaggcuguuugauacauucuagcuaaaauggcagugacucuccuuuauagccuuucuugccuacuucuaugaguguguuaaguguuaaaaauccaccacgaugugacuuccuucuccuuucaaguucucugaugacauauguccccugcaagcaugcgucccccugcaagccugaacuggugcccaagcuggggaaggcacagucagcauugccagagcuugccuggcugcuguguacauuacuggccuggcccagcucucggaguguccccccugugcagaucgaggagugcugugccccucaggugccauagguacuggauuaagcaggucugcuauugcagacagacaccaggcuccauucuaucguggagcuguguuuggauuggaguuuccagggccuuaucaggagccaccccuagugacacagccggugccagaaguaacuuugacuuucacucuucgccaagggcuugcagaacaccuuaaaggaagaaagauggaggcgcuuagauuugagaugcucauccccugcuccuuugaaagcuugugucuguaagugaagcuuuauucuggagauaguucugggaccacuuaacagaagcagaucauucucugaucgaggaaggaaggcuugcgaauuagaaauacugccugguacuuuaaacuguggcuuucaaucagcugcagcucuaaccucuugugccugggugugauaaggggcaagagcucauuuggggaggagggaucaaaacgggagccuucucauguaaaauggaguuuuggucauuaauaaugacaggaaaaaaaaauccugaguuugaaagauggguuagggcagagcagagcuugaugcaguuaugaaauagaucacgguuuuguuaugaauaaaaaggcauuuucuuuaggaacaugcaugcucuguggcacguuuccccaaacuacccugcugcacacauuguaacccucccccucugugugugugugugugugugugugugugugugugugugugugugaguguguguguguguguuuguuuguaugugggggcuaauucccugacuauggaauauuguaaaauguucugauuuguauuuuuguagauuaauuuuuuuccuugaaggcaagagcaaaacauucagacaucagcauagucuccuugucauagaaauacugaacaagaugaaguagcaguuuuacaggaguaccaaauggaaaccgacuaaguagauaagaccccuucuccucuggcaccugcuuuccacuuucacuauuacucccucagauuaggaaacaauacuggaagcugggucuccaagugaaccggcucucaagcagauuaacuuaugcaaaagccacuucuggagcuuaauaauuauuuacugaguguuccugggucaggagagggguucugauuaaguccgagaagcuauuuguuccauagcuggugaaggugugcuugaagacagcaagaagaauggaaaaauacuagguguagcagaacuauucuuagaauuugauucuuaaaaaugaaauucccauaaauugaagugugggcuaacaguccgucauuugcagcugaugggucuuuaagagguccuguaaaggguaauuuugaaaaugguuucuauuucugcugaaguuugcuuuuauagauaccuuguacauucucaucccacgugucauuaaaacagcuaauuauucaucuuucuaaaaugaucgagcauuuuaugaacaaaguacauauaauuaugcauuugaaauaccauuaugcugaaauuuuuaaaaauaaaucucugccuuauaaaucagauaauaguugggaagacagugccugcucguugugagucauguccugccggaauguaccuacaaccugcacauguuuuuaguucuuuuuaagcaaguugagggaugacacccaaucaaaugugccuugaaggugcagcauuaggacagacucgaauguguccccaaauuaauccuuaaguuuaaauauuuuccuagguaacuauaauauuugucacaggaauauguaucccuccaaacuuucugaaugaaucuucuagcaaaugucuuugacaaaacuugugcacugagcuguuugccauuaacuauuuccccugccugggaauuaauuguguauuuccuuccaggaaagccagugaacaccaaagcagaaaggaacauucuagacgcuugucugucuugaaaauaauccaagagcuuucacuaugugggugggggcgggggggggaguugagauguucagcaaauguguuucucugggauuaaaguacaguguugggcuggaguguugggcucaguggguaaagcccuugcagcauauggguaaggagcuguguucaggacucucccauccauguaaagccagacuugguggcaugaaucuguaaucucagaguugcuauggugacaugggaaguggagcuuaugggucagcuagccucgccuguccaauagagaacaagaaacccuguuaggagcaagaugggaaguaagcgcugauacccauaguuggucucugacccugauucucaugucauggcacucacgugccuauccugcaaugcagaaacauguacaaaucauacacauacaucacacacaugcaugugcacacacacaugauguaaaauaauuugccaugacuuuugugcauuguccagauuaucugugggcucugaucauagcacuuaacugucuuaaggcaauuucacaguuacugcaugucaaaaggccuucuuccauugccguuuugcacauggagaaccuaagcucucaguaggucuaagcccgcugaggucuuacagcugacaugugacagagcuagaacuggacuccaagggugcuggaaccagagcuuguucucucauuugucuuauuugcuauauugucacuggaaaugacaaguaaccugguucauuccucugguuugaugcugagugagucacucccagcuucuuucucugaauuaccaauaacuaacaguggugagcuuuuaauggguugugguuccucuggauacugcauuuuuuuuuugucagagauaauuccauaaaucuaauuuaugguugaauguguggcaccuguccaggggaggaggaggucauugcauggauucauugaugguagggacuaccuccaacuugaaauagagagaaauucuucuguaaaggaaagaaauauuggugauucauaggacucaaaguucuuggucacuagaugacucaagcaugucuauccuuugaccgaagcgcuccuaaaacucagguucugguaucgaugauuccaugaaguggaguguuugcuagaagagagauaccaaauuuacucauugaacaaacacuugucugugugccggaaaguauacaguaugaaaaaacaaaacaaaacaugugaucaucucugcugucaauggaaccaacuuccgcagggcuaaagggucaaacauuacuagacuuuuaaguccugcucauccuuauggcccacagugacucccagaacuccagccaguacagccacaugacaggagacaccacggcagaugcuucaaggacaagugucuauucaguuccuggagccaccaccugacauugcuucuuaagcaucguugaccagcuuuaggcauguagccaucauaguucaugaaaagcugggcaagaccgguagcagugugacuagcuaaagccaguagaaggaaggacagguugaaaaucugcagugcucugaaauccaaagcuuuuugaauacuauuaugucauaaggaaaaauucacacuugaccucuucagacaaauugccaucaaaaaugggcuuagcuaaaacuauuauauaagaugaccucuagucgauauguauaagggguacaugaauggauuucauguguauaguugguucugcccucaagguuucucauuaugugcauguaaauguaaauuuuauagaauugguugacacccauguccccuuuaagcaccuuagauaagggacgcauaaccaucacauuaugggcuaaaugcugauuucucuuuuagagagcugcuaagauuucuuguacaccagacuguacacuauuugcauguucauuuguuugccaauaaauauuggcuagauuucauauaugagaaagaauaagaauauucuauuuauuuccugagauugcgugaucucgcacagcgcauacagauacauacacacacacacacacacacacacacacacagacuuuuuaacuucagguuuguuuuguuuuguuuguuguuugagcugaguaauauuccauauuuuuucuaguucuaauccuaucauggaguuucugauuuugguaguggacaagugcauaaaauauauucuauacugaagcuguaaaacuuaaugugaagcuucacagcuucuguucugaaugccuauucuaacuggacagaugaucagugacuuauuguauagauuugaaucuaguuaaguuuugguaugcgauauucuuauuucccaguuguggaauucuaagacauaucaaaacaagcuugagcuagaguagagaugggucggccuuucugaaccaauguuuagggguaguccagaguuacgcagacuucagggauggcuugaucccuuuagugcugucuggacacagugcucucccuuuuguucuuugguuccugcagcccuugcuacuguuuuguacuucacauucuuguuucuagucugagauagaugcacgaaacucaguguucgcuuccugcuagauuucugguugucaaggagaguuaucuuaccgcuacaguucuagucagaaauggaacccacuguaccacuguaagguuccuuucugacccuguugauagaggacagauaggcugauuagcuaggccugccuugugcauucgugagcugaaaguaagagauguuggcuuugcaaggugaaauugguggcacaggaugcuaagugggccauacuuaacgggugggcacaguaagccuugguggcuacuugcauggcugccucucuacugcaucagguacacccauucaccaauuauuuuuuuaguuuguuuguuuguuuuguuuuguuuuguuuugagacaggguuucucuguauagcccugguuguccuggaacucacucuguagaccagacuggccucgaacucagaaaucugccugucucugccucccaagugcugggauuaaaggcaugagccaucaccgcccggcccauucaccaguucuuauaugauaaugugccuaucuggauuucaaucugguguuauaaucuuugggucuugguggauauauucuaagcaugcagugauuauuaacuauuauaaccugaagcuuuuaaauauuuguuaaacuaguacaauguugucuagacaagagacaacaugauuuauaacuggggaauugugucaguagcuauagaauaacuuuaugccuuuaaaaaguucuucuuuuuuguuuuuguucuuuucuucaagacagggucucuuuguguagccuuggcuauucuagaacucgcucuguaggccagguuggcuucaaauucaugaagguccuccuaucucugccucauaagagcugggauuaaagguaugcaccaucacugccuagcuaaaaaguucuugcuuauagcuaggugugaaugagaauccauaugggacagagugagcaagaauugaugaguauggaacuaagaugacuucaagguuaagaguguucuuacagaagacccgaguuucuagaauacaagccagguagcucacaaucaucucuaacucugucugaagauaucuaaaaccuuuggccuccacucaguagugucacauaggaguuuuaucucaugaaguaggccuuaaauccaauuuuaaaaaugucuggcuacucugauaacauggcacacucuuguuccagugaucugcuuuauagacagaucucugcucuagcucacaggguuuguagcugacugagagugaugguuauuuaucuucucugguaacauauacaacacugcccuggaccacuaaugcuacucaguaaggguaaggcuuccagcucaucacuagcucaaccucuccauacgugaugacaggaauauaugcugcuuuggcaauagggucuuacugucagguugugaaguguaacugaucagauuggcaauagccuauaguguugguuuggggaggcaucugugggacuccuuuugccaaugacucaaaaagauguagcccaguccugguacugucaaguaaaaugaaauuauacaauucacacauaaguggauagagcaaugacccuuagugagguuacgcagcaaacauuguauguuuccucuuacuucuagauguuagcauuuaagcuuuaaauuguguaucauucauagcauccgcagagauuagguagauaguaagauaucagggguggggaaucuuccaaagaaggagaaauagaauauaguuuuaugaagggauaaagaauaaauuugaauagaagauuaagugggaagugcuugggagggcagguuaggguguguggugucuuguuaacaagagacuggcaguuccacuugaaagacauaggaaugagaaacacuugugaagcagugaagaucccaaucucaacccagucugguguugaagugccugggacagcgucaucucuguguuaauuguaaaggucucuaaguaucguuuuuaucccucuucaucaguuuaaaguaaaucuugucagcauagccauacuuugucaauuacaugacuaugccacuguaauaauauacuaaaugagcuaaguuauacaaauagaaagugaaaaugagaucaauguauauaauggaauauucuacuuguuuucccugugcccaagggcaucacacuauguguacucuuuugagaaugugauguacugucagcugaauuaugguucuguugacuuucaaucuaguuguuuuugagcuuacuguugccugauaucuggugguccaacuuagagaauauagagaguauugaaugcugucucuacucucuaccuaccaacugggcuuuugguauugguuaaauaaaaaugucaaguuugaauuccauauggcugaggguucuuaauuuguaaaguuucuuccuuaugugcaaaugaaaagcauaaaucuccaaagccaguuuggacuccagauugucccaaacgucuaauaguaccaugccauuagaaaaauuucaauuauugacuaaaaauuguuuaaaaggaagaagaaaauccucaguauuugacaccaaauuaugaucacuggcauguuccauuucaugguuuuacuccuagagauugacuuaucuggucuuacaaugagguccuggcaucauagucagguaagggauuggcaggugaugcuggccagauucuggggaccugauagaguuacugagauauauauauauauauauauauguuuuucaagauaggguuucucugugaagcuauagcuguccuagaacucacucugaagaccaggcuggccuugaacucagaaauucgccugucucugccucccaagugcugggauuaaagaugugcgccaccacugcccugcaaguuacugauauuuuuaaccugucaguaaagcuaaaggaauaaacuauuuggacuuaggaauaugccuuguaagacagaacccuguccaguagcccuuuaccaucauagaggaggcuuugaaagcuaaaaauauaaauucaucaaaaggggugggaacugagaccacacggaggguccaccccuugccaguauacuguauuccaacugcugcauugaacaauuuaacauuuacucacucuguccccacagugucuagggguaguuuuggggaacacucugggaggcugaauggcucauuaaagcucacauuccucaacaguggcugaaggagaacucgaguccacucuguggcccuccuugacuaguauggagcaagccccacacucagggaacgaguucagcuccagggucagggaggugucagcauacuuguggccaugccuguggguuuaucuuucugagggagaggggugcaccuuuccauguagcacucgaucagaagcuagcgguccagauaauugacaucaugaggcaucugggaagaauuaaucuggccagggcuuucaccaugggguugggagcuaggugucccagcaccuagcaacagcuauuuguugaaucaaugaacuucacauaaucagguuaaaaggaaucauacucacggaauuaggauuaacuagcuagagcucagguucauggguccaaggaugagcuuagucagcaauuaaaaucagacacacuggacaucuccaugugugucacuaguggcguggucaguaaguccucguuuuuaaaagcagucauucuggccccuuggaauaucccuuacaugaacuugcauucuuuacuaacucuuacccagucuuucacaaacuggcacuuuugucuuugucuaugaggagauaauuacagauucaguuacuucuaagagaaguggacacucaaaagauggugagccaggcuaagaaucugguagucaugucucacaauguggaaauagccgagagagagagagagagagagagagagagagagagagagagagagagagagagagagagagagagagaaugcgcgcgugugugugcacacagaguucuguugcgcuauccccuuuagaaaccuuuauucagcugucaauuagcugagcuuuguucuguuuauauacauaugaaauaugcuugcuauuguuucuuucaugugguuucccuguguuuguuccguucuauuguauaggucaguauuauuuuuuuccugauaagacuauuauagaagauacuuuaaaugauguuguuauugugguugaagcaugaagccuuagugagcuugcuaacuagucauuuuaauuugucuccaggaugcuuuacuauuaauugaaaggauuuucccccugguauugcagccagugacgcgucuugugcaguuaauuagcacgauuaugccacagcuccuuuugcuccugcacaaagguuugcucuuguuuuuaucaaaaggaucauucucuccgagaauguugggaccugacaggcucugaauaguaagaccacuuauuuauuuuuaaauagccacccccaaucuuucucgguuuaggaaaguacauuugagcuuugaagagcuacucuaaaaugggaaauacauuuucuuuagaugcucauuuuagcagauucugugcuagugagugguuuuaggcuaacagagcaauggcuagggaacauuuugauugugugaaugagucuacaauguuaagauaauaagcaaaguauauacgcugcuuggucaguguucccuguaugucuguagggaaugccggggaaaacagaagaaaugggaggauguuuuagguuugggggcuacugaagucacucaggggugccguggucucuuccuauaguuaaaguagugucugagagcucuagucuccuuucuaauagccucguggugagguugaucaccugucauuuucuuuaguuagugucuauuguauauauugccacuggaaaaaauacuuuggcguuauuauagcuuaaaggagaaaagcugaaagaaaauugauuuuccuaaguucauccccacucgggcaaguguguuugccccauacaucauucccugcuaggugcuuuguggauuuccacauacaugcugagcuuauaagccccaaucagccuguaaauccacuuuggaaucugacuuuaugauucauacuuacugcgcguguaugcuacuuuguuguucauuucgcauuuucaaggaaauaauguaauguguuaaugaguucauauuuuauuaauuaaccauaguuauuauuauuuuaaaaaaaauaggugauuuaggauauuuuuaaaucuguaaaagccuuugucuaugugaauuuuuccacuuuugauuuccuuggacaacuacaugucaaggaagcuucugaaacaaaauaaauaacuuauuuuuaaccuuucaauauaauuuuauuagagcauaauaauaauaauaaugaauuuuaauuaugcauuucuugucaagaauguguuuuuaaaaauuggacacuacguagauauuuccaccuugauuaaaacauuauuuuauuguauaguuuuauucauaucaauagucuuauuuuaugggguuuuaguagauacaugguauuaaauuuugugauuuauuauaauuuacugagccaguuuucuauauggaaaauaaauaaacuucuaggaucucuugggggaugacacgagagugugacucagaccuuuaucuuguagcacauccggucauuugugaaguguuuuguccuuaggcuaugcacagagauggccaggggccuuaggacuucugucuuugguaggaagguaaacacgguacugggguuugcaguuaagaggaaggauaaguucugaugccuccccuggagucugauagaugcaaauguucuuuuuuucuguucccagaagcuaauaucuuuuaucauaagcuugcacaaaaaucugauaauuauaauuaaguuugcuucucauacuagauggcaauaaaagcaagcauaaacaucuauuggggugaugcucacuguacacggggguuauaagcacugcuuuauuuaaacuucauagcaucaguccuuaggagggaugaguggugcagcagauauuuaaagaacaugccgccacuuuuauaaguggauaaaaugcuguauacaucucuuccagguaugaagacccaggcagaaagagguuuauuauuuguucauagcacagaguuggcaggauaagcaaccuaaagccacaccuagggaaaacaggaagucuuuuauucuuaccuacugacugccauguaagccuguuagauaauggcgaacagagugugucccuggcuuuuagaaguagaccugauggggaauagacagaaccccgaugccaugggcaugcucagaugagucgaaaggaaaaacacacaaagagaaccaggaggaagacuugggcugucacuucagcuucucuucuguccccuuguuuuuggacaaggggaggaugccguguccacaucugguccauaugcuucuuucguuaaugauuugggucaucucuugucuuccaaaccuuuccaguaacaguguuuccuuacgagcaaccauauuagacaucuucaaggaauuuagauaacauguaggacucauugguuguuucgacugagcuauuuuaaaaaaugaaaaagaaaaagcaaaucaaguaauuuguuuuugucuguggagaguugcuugccauugagaccaauggcuccuauuuguugguuauaucggcauucuauucaguggugauuaaccguguguggcauaaaguaucgaaaagaaauaagugauuugauaaaaaccccagaugcaaucagccugacuuauuuuaauuuuacuccuaaugacuugaauccugucaccucuugauuuccaauuacauggagugccaugccgugccuugauuauaucugugcagacucaccuccuaguuugguggcauuuaggauacccccgcgaugcaggugaugggucucaucaggauacuaaaugcugugugccuucugguuuccccacagcaguucugcagagcauucuggggccuccaagccuccguuaagcuccuccacuaugacaucacgcaucuugcuacgccagcaacucaugcgugagcagaugcaggagcaggagcgcagggagcagcagcagaagcugcaggcagcccaguucaugcaacagagaguggccgugagucagacaccagccauaaacgucagcgugcccaccacccuucccucugccacccaggugccgauggaaguccuuaagguaugugaguguugcccuuguguuuggaccuagccugucccuucuccacacccuagguaucacauucaauggacugugucuuuccuugcauugcuauuagucuuauuuauaagcauugcuuccagugguuccuauaaggcuuuguauuuuaaaagaaguauuuaaacucacuguaaauauuauggcagccugugaguaguggggagagucaacauuuucaugaccaaucccaaaugggaucugauguuuguuauaacaaagagcauuucucuuucuuucuuuuggaaaugauuucagaguuaccugaaagaguccucuucuagaaacuuauguguaugucuuccuaaaugcauuccaggccacacuuuaacuuugcucuucaguuagcaaacccugcuggcccuagaagcuaauuguuuuagaaagucucuuuucagaaagagaacuguggucaagcguucugccugugccuuaauaaccagacuucauaaucccuuuacugaagcgagcugucugcuuugggucucuuugauuucuugcuagggugaagacugcgggagcuuguuaacauccuucuagcagagacacauagcuuccuaauuaccagaggaaguuguagcaggucaaagcauagagcgcuauccccuacauugucuacaugccacauggggaguugccguguuucauaaacauuucaauuuguaaauaugacugguucaaaaaagacuagagguagagaaacuuccauacguuguguuuacguuuuacccauucaccuaauugauccauucugaagagccaaguguuccuguucauuaagcaaugugagcucugcaugcugcaaauucauuguuggucuuugcuuuuacccuugugcagaaaaaaaaauccuuccaucuucccuacuuaaaguuuauuauuaaagugaacaggagcagugugcagcacucaggaucugucugugaucuuuuccaugaggaaaggaauucuuuaaaaacuaacuuuaaagcaccacauaguuauuuacaaagauuuuaaaauuuaaagacccuauuguagaacucuuugauggagaaaccaguugaaauucugcuaaagcaaagugacccaacugguucagcauaaaguuuuacuuuaauaugaccaaaauucugaauauugcugcaauuaugacucuuuuauucuuccaccauccccugucaaguaaaaacaacuuuuggcuguagaauaaacucuacaugaaaucucucuguccugcuuggguagagccaauugucccuauuuaaguuguaacagauuuaauuauuguuuucuguuugcaagagccauggucauuuuguuuauacuuuauuuaaacacugugacuuuuauaauaacaaguugcagagaagaagaccuguuuuauaaaccauaaucuuaaguuuguuaacugaaaaagcaaauuuuagaggcagugccggggauuugaguagagugguuuacauucaauuugaagguuaugcuuaauuguagugagguguauuggcuugaaauggauuuuccuguaagagugauuacauggggugguggagaauuuaccacaaaaugaauguguggaaacaucauuucaauauuauacaagaauuuuuacaauuucugaauguuuaaaguguuaauuucuagccucauuacaauuaaaaucuauauuaaacauuugaauacuuuauguauuuucccuuauacucugcuuauccagguaauauuggauugaacugcagucuccccacaacuaaagagugccagaaaaaaaugccccaaguuaaagcaaaaauaaguuacuaaagcuagaagacaugagcuggccgaaagagccaccgguuaaauuuguuuauugugcucucaggaguuguuaccucuguuuaaguggagaguguuaaauagaaauaucuccuugggcuguauaagcgagccagccaugucucauaacgagaagggcuuguuggccuaacaggcuauagagagcugauagcuaucuagacaaccuuagggacuuugaagccaaagaacaaauuaaaacgggaucgcauucaucagagguaauauuguaagacagucaaaccucaauguucaggugaauuuccuauugaugauuccuugagaaugacugacuucacacuuuauaaaaauaguuucuuaagcucauuguauggaauacugaaugaagaagggcuucauagacacacacacacacacacacacacacacacacacacaccccacagguucuccuuuccuuuucucauuugugacuuucaaaucauagaacacaguuucauaaaguauggauauagagaaauagcugauuuguuucaucuuggaccauuuuauacauuuuuaaaucauuagugaugcaaacauaggcuaauugugugcauuaugaugugauagacuccauugaacacauuuuucggacaguauauccuuaguaaauuauugauuucauuuuuauaguuuuaaguagcagggcaggugcauauccacuucuccuugaaggcaggcagcuguggaaguggagaaugcccacucagucucuccauuuuccaguguguuuuuacaaacacgcuggaagaaaggccaaagccuaaauuuuauaaacacacauacuccugucaccaguaacccacugccaguagauugagcuacucauuuugacagugguuucagguuaaucccuuucucuggcagcauuuuacucaaacaacggaacucucugaagcauguuuaaaaauuguugacaucugaaaacuuuggguucauuggaauucauauuagaguggaaauucccaucauuucuuccccagaacaugccagaauucaugagauacagccucaguauucuauauuaauuucauaaauuugugcauuuaauccuuauauugauuuucacaguggauagcauggaguguuggggcuuauuguggguauuugcacauuagugagguguugacuugguuucuuaauaacacuauaauaacaauaacaguuuaggaugguaacucaaggaggcuucuuuacuguaaauagugacaucaggggugcauaauagauuuuuuucacaguugugagcacauucuauguuucaaauagugaauuaaaaacuuugcuaagaacuguuuauggcucgcuuucuucuauauguagaauuugccagcaggugaaccauaagaacugaggcugaacgugaucuaaacaaaaucagucaccagggacagacuuuuagccauggugggucucacaucuacagaagcaucacagucaagauggcagcacacacagacacacacacacacacacacacacacacacacacaaauagauggacuugguguugauaacacucacugagccucuccugucccugguuuaucuauuuaucuguaauugauuauuggagcagaugcuacugugaucugucaaauucuucaauuuaauccccugucaccuuuuccauagacccaggcaguguggagcauuauaguaguuuauaauugauauuccuuucucuguugggaaacuugcaagcuccuucuuccaacucucuuccuucuguuaauuuaaggaucaaaaggccagcuguucuuucuguuguauauuaaauuugcucuucucuguuuugaaaaaaaaaguguugauggaaaagaauuuuugaauuauuauuuuaguauauuauugacuuuugaaggaauuuauuuucaauauuucuuuuuauuuuccagaccaucucaggaauugggcaaauugcuuaccaauuagagauaauguuuucuguucaucaaagcuaggcaugcauuuuccaggauccugcauguggcagacuguuaaccugggcauuuaugggugguucucucaucgauacucugcacguuuaagcagaaacucuugugagugcugacgauagacuagugcauugugcaugguauguaaacagauuagguguaucuccaacucgacacuuaacuuuuguuccugauuuauuuagcugguauugagaaaucugaaucucaucacagugaauguuaaagguaggaaagcuauggccucucucaggucagcuugcguuggucuccugagucaggauucauagcuguccccagaagauauggccugcugcauuugaguuauccucuauauucauacacuuaaccugccagucagugugacauacauaagccuccauuucaaagaguuuuauaaauauugaggucauugugauuuugcauaaaacuauaugucuucaagaccacaucaugaagucuuuuuucuucuacaaacagcuccugccccauaccaccuaauuucuccccccaccaccccaucucgaccucccccccccccacagggacuuuauuucauagagagucuuagacuuguucauuguuaccuauaagguaauuucccugauuuuuaagaccuauugaguaauuuuuagaaauuggagacggcacuuguuaucuuccaacagauuuccacagcugagguaaaauccaucaggaaaccauggcuuacuuccuguagaacuauggccuuucugccguuuccucuuuccagugccaccauugucuuucauaggagcacagugcugagcauguagagaugacccuucguauuuucucuauguugugucuacucuugagacuucacaauccccuacucuucucugggccgaguagggacucucgauugucuacaaagccaauugaugguucugcuguaagcaagugccagcuugcuuggcaccaccugggagucauucaugucccauguagcuugggaaccccugugaauaggaaguugcuaaugucagggcuagcccaagaagguauuccacugagcugucuuaaaaggcacaauucauauccuuauucucauagucucugucuccacagauuuugugaugaguaauuagcaauucaguguuugcuagacaaagccuuucuuguuuacauuuguuauguaagcauuacacaaaaauaguaauugcauuacuagccacaacaaaauauccagccuuauaaauuaauuauuucucaaaauauugagacuuuaacaucuaguugcacuuuuaccugaggaugucagcaaaaagagguggugugggaaugggauucucuuuuuaugaccucuaggccaguuuuuguuuuguuuuguguuuuguuuuuuaguguaacugggguuaauggagccaagggcuuugauuagaaucuuagauuucuuuuugguuucuucaguuuggggcuggcugggagcagcuauaccugguggauauguuaaccacauagcagcuuaucuuagaguagacaggucuuuaguuugucuccaugacccaccuggagucccugcagaugucuugugugagaggaggugccagcuccccauuccucauguuauugugucaaaggaagauucagucuuucauuuaucacuuaucccuauuaguugggguaagggcaauauugucaggaaaguauuaagggaugagacucagggugagggcaaguacaagccaggggguaguuuagugaacucuacaaugugauuucccuuugaugugauaaguuccguagaucauacguccucaacaaggguagcaucaucccauuacgggaaacaagauugguucuuagagagcaaaaauccagguuuaugagauggcucagggaugagagagcuugaggugcaaacauguggaucuaaguuuaaaaccaaagaaaacacauacaaagcugggagugacuguguaugacauuaacucuuacucaugggaggacagagacagcgugauccuuggacuugaugacuguuagcuucaccccacguucaccgagagagaccguugccucucauugucuggugucucgaaggaaaaaugcagagcgauggagcaguacucccaacaucuucuuccggccuccaugcauacaacaaguaugacaugugacgucugcauauguacacaugaacacacacacacacacaccauagaugucacaguuauuuguugcucucaacagcuucaguauacagcuaggaaagcaguguuauuaugucuguuaaagguuugggaaagugagucagcagaacaccugaaaggucucagaggcucacucaugaggaaagggagaacaacacugcugcugaguccucagaaucuccugcucccugccaguuguacuucaagaacauuggccaggauuccuguagacauggcuucugcauucuggcugggccuuccccccccccccccgaacccucauuacaaucacacucauguuuagcauggggccgugguacucaauaccacagauacaggaugcugcccucaucacuguucugugaggcuguuguuagcacccccauucaacagaugcauagacaggcguggaggacuuaaauaggccugguaaagucauuaaaggcugagguguuagcaggacuugagcccaggaaguuggcuacuuauaguaguuaguaucuuucuuagaguaaccagagaagcuucuagagaagagauagauguucaaccccucaagugauguggccacauaugagccaauagcacuuguccauugcagaccuccuggcuauggcuuauaacguugguaggaauugcuuugauggcauggagggaaggcaagacagcuucgcuggcuucuggaacugauuguagccacauucagugacaggugaaaggaggacauuucaguucauuauucucuuaccaacccuguggaucuguaggauuagcccagguaggcaaacaggcauauggagauugccucuggccucugguuauauuguuaagcccacauacuaagcucucuacuauacccucucuccaaguccaagcuugucucaaugaccaccagaaacagcgcuuuuaaguaaaguaagaagccagauagaaauaacagcggaaucucuugggcucaacagaaggcugcaugauuuucauuggggauuagucagggccuucucuguugaauaauuaaauuuccuucccuagucuccaagauacaugcaaccuaggaacugacuguguucuuccuaugugagaauucugucucagcacacugaccauggugauacuuuuugguuuaguaacugaguugucauuaugagugaaaaagcaguaguacggaguuuccuaaagcaacaucugaaaaucuagagcugggaucuuuauagucuaagggucucaauggcccagccuacuccaauuuaggugcuucgucccucucuauguucagcgaugccuuggugcaguucuaaaugguuuuuauucacuccccauaggaauuugccccugaaguuauggucccauuuuuguuguuguuguuguuguggcugucuuuucuccucccuucaguaucagaacuuuugacauugcucuagcacuuaaaauccgaacuucagaucugcuugguuuucuauuugcuuuuaagugaaugucaacuguaauaauaauuauauuauugcacaaggaggucacaguccccuucacaaacucugccuguuucaucucaguuaaagaaaagauaaacuugaaagacuacucauggaugucagugggcuuuagaacaggagagaauuuggacgcaucuaagcaaaaucuaaauuuaacuucacccuacuaaaauaaauggcuggaauuuguguuaaaaauauguaaauuaguacggcagcuuugcucaagguuauagcugcaaucaguacuagaauauuggcucuuguuccgaaugugucucuucuuauugcuuuuuugaauaucagccuaaacuugaaaucuguagcaucccacaugcaucucccagcuugucaggucuuguuuauaguacccuaacuacgugagaagauguauagaaagcauguaaacuagaaugcaguuaacauagaauguucuagaaagaguugcuuuaaucacuauguuuaaaauugauuaacaccuagagggcagaggccacuggaggcauggcucaucagguaagaauacugucugcucucccagaaauccugaguucaauucccagccaccacauaguggcucacaaucaucuauaacgggaucugaugcccucaucuggcaugcaggcaggcauacauacagugaauguauguacauuucauucauauacguggauuuaaauuuuuuuuaauugauaauacaagaagaugguccagaugaaucaaaggcauauuguuccuccuggagauccugggggugcugcuacgguuggauauaacaguagugaaaggcuccgcuacuauuuuccuuuaaacuagauuugcgauuuuaggguuuuggaauaauagcucaguuggugaagugcuugccuugcaaaccuuagaaccugagcuugauacccacacccagaccugcaaucucagcucuggggaggcagagauaagaaagagcacaguagcaggcagcccagcugagcuggggaguccuggguccaggagacccuguuucaaaauauaaggugcagauuggcagggaagacagcuccugucauccucuagccuucacaugcaugcacaugcacacacaugcacacacauacaugaggcacaaagccuaggagacuggguucguguaguauuuauguaacugaccgugggcaucuuuaacauauuuuaccuaagaguuugaugaauuccuaaucaccuacuacucucugaggagcacacugcuucuacggguaggccuaucagacucacguucaucccacaguuucugaaguuuuccuagaagcaagauaaaaagguucagggacccuggugauuaaaaaugagccgaaggaaucuaaucauccgguugugaauaauuuuaguguugcaaagaggccuaaaacaaaaggcgcgacucagguugcucccucccuuaccguggcauacauaacuguguuguaaucuccccuguuggcccugguuuuuauauaauuaaaauuuagaggcuggaaauuuuguugagacuuaauuagaagugacaaaccagagacauuccugccaguuaggaaaggcuuaacaaguucuuauuggcuaacuuacaaauauguagcauuuucacacugccuaaaggugacaagaucagcucuguuuuucuagugaacuaguaaaaauuagauuaauaaguaccaggcaaagaaccuuuucuuuugucuuuuuuuuuagccccaaagagaucuuaccuuugaguacuucuggcuguggagauuggugccuuaauuagccacauguuccuuuugccuccugggaaauaaguacaggcuaaaauuggggaucaagacacaggcguacauugacuuagcacacgccgccaaguaauucaucaaggaauguugguaauuaguccugccucuuucaacucuuggcuuauuuuauaaaaccgguugauuuaaaauaaugccugcugauguauugcccacacguuucaagaccgggacuuggcuccucaacaaaagagagauuguccagggagggaaaugugcccuccugguuuuguguuuucacagauuuugagacuccaucuaugucaccuauuaacucgggugcucuuucucuuuacccuauucaacauuucauggggccuucucuuuuugccuugauagaaagaauaggggagcaaacuuaaaaaauaaaauaacauguaagcuccugggaggugggggugggaggguuggauguaaggagcuugucacagugugucaccucaguguggcuugauggaauuuaauucgaauccuucaucuggugcaagcugcaguaaugaucuucuuguauuguuaaaugcuugcugauauuuauggcagacagacuaaucuuaagagacuggguuucugggguucacaagaccuugugauuacagccucauagcauguguaguuaacuguuuuagaaaguaaccugaaugucaaauucccacgcuaagugaugcauuuaccguuaugcuuugagauguggccacagucagagcugcucuugaagaucagugauagcccgagcccaguaccacacugagugaccauggcuguuuucuccuuagaccaugguauccucaucuguaaacugugggcaguaaagucuacucugggggggggggggggggcuuuacagaugaaugaaggaucccccccaggccauaucacucaagucauaugccaagcucugacuucagagccuugaguccucaggggaaaacaaaaagaagcagacaaaauuaauuucaauauguuuuauacaaccaaguauauccagaacgucauuauuucaaucuauuacacgagaauuaucugcagaguuucaacuuuagcccccucaucgucuuuguaaugagucucaugcuguccucuaauuuggguauauauuucuugucuccuacauauuguaguuuggagaugaaguuucaucugaaugacuuguccugggguuuagaucucauaaaauuuucacucauuugcauucauuugcuaauguuguuuuaguccuguaaagaagcuuucuagugacuggaaugggguggaggcuagcuggcagaguguuugucaugcaaaggugaagagccagagccaauugcaauccacagaaccuaggaaaagucugacaaagcagggagcaucucucuuaaccagguuuuuauaaggagaugggagguggggauggcagaaccagggaaacucaggagccgguagucaggcaggcaacagcuggaaccucuguuugugagaagcaagcauugaaguuuuccugagucuacauguguguggugacauguacauaccuaaagucgaucaccugaacacacacauacauacacacacacacacacacacacacacacacaugcacuugaguguacacaugggggggauuuaaaacaauuuuuuuccaguaauuaaauugauuauuuguuucaauuuaggucuacaugagauauaaaauucagcuccuucuuaagacuuggcccccguccccgggcucaguaguuucaaugcccugugaccuuuggauuggauagcacagacccugaaggauuuagcacaguguugaguacaaggagcgucaucaggaagauuucuacuuuauugguuauaauaaauuuauaaugauccaggaggggagacuguguacuugguagagugguuacaggcguggagcauguguaggguuuacuggccgggccagccugguagugaacucuaguuagugucagacauugucucaaaaaaccagguggaugacccugaggaacaaaacccaagguuaaucucuagcaucugcauauauuuacauguacauguguguaccuacauauaugcauguaccugcacacucaugaacauuuacacacuuaagaacauaccugcauguuaagaacauguacauucacaauuuccggugacuuauauuuauuuaaucacuguacacaguaauuauuauuaucuucccugcaaucuuauacccgcucauacagaaacaauuuaguuguuaguuuauuucuguuaauuuugacccaaguucacugucacauaacauucccggcugcugccauuuccuguccuuuuuuuuuaaaucagcuccuguaggagagagcagugaagagucacccucuccaaaggugccaagcgccuuccauugagcuaugaguguggaggcagcucuugacuugugagucacacaucuuacucaugcucugaggccaggguccuugccaacccacacaugucacaccuuccucacgcuuacccagccugcugaagagcucugaauggcaaggaaugcaugagcgguuugucagugcgcugagugucaaggagacacugaagagucagacgaugacaagucaucucucguuuguuguauaguggauguuggaugauggcuugccucacacaaaaggcaucggaagccuuuugcuuugcaugaaguuuuaggcacgauguuuacugucuucucucacugacccuuuggaauauuuuaagaaauuuccagcacugccuauaauucaauaaaauaggccuuuuucuuauucaccagggagcccauuuuuuuuucuguucucaugguaauucucaaccauuuuaaaaccagaaauaacuuaacuaaggugauaauuuauuuuguuaaguaccuucuuauucuagugcaaagaaugacuccauuauauugggauuagugcacuguggacaggcuuguguucuuccuguuauuccaugagccuaccaaguccugguccacuuacaagcauggaagccaacacagcaaaacuguucgugauucuaugguuucgagagagaaaaaguauuguuuccuuccuauuucagguuucccuagguugggaauugugugcauguauguuuguaugucucuguguuaauuauuuauuauauaaauuauauuaauauauuacauaauguguguauguguguuuguaugucucuguguuaauuauuuaucauauaaauuauauaaauauauuacaugaauuuuaauuacuuaaaauaauaucuagucaaacuucaggucauuguccauuucauuucagcuuccugguagcuuuuuugagguuguuuuaaaaacuuaagagcuaaauuuucuucucaguuuauuaauugacauaaucuugauaaagcuaccaugaacuugggcaaaugugcucauuuucuuuugcacuuggguccucuucuauucauaaggaaaagacagccugacuccugggaaaggacucagaauccucucuagaacucuccauuuggcuugacuggaaucugaggugcucaugacuuaaccaccacucccaucuccgugauucccggaagccuguucagggacccaaaggccuugcaucaccuggggccucauuaaauagcagauucccuccaccuacccuccaccuccugggccauucugagguagguucuggaacuuucaacaauacugaaaagagaaggaaguagagucaaccaggucucuuuccuggagggcuuauuggguuccuuuagaaguaaggauccaugaugucccaccaucaggacggcaccagguaaaaccaagaagagagguaggaagcagauggcgaccagcagcacugggguggaacaggccagcagagacugcaaaauucccagcagcucuugaggauguuuuggaaaaaaauccaucauaugcaaaguugauucaaaaaauagaugaaaccuuucaaauuuagaguagaugacaugaggguaauaagaaacuccaaacuuuugcacauuagcuacagaaagcacugggcuuucgagagagcugcaaaaggcaaaugaaucccuuuguucacacaacuugugaauucuguagagcucuugcagacacacuccuccuaaauggagacacugccgacacuaccuuaccuagcaaaauacaaaucaacaggaaaagagcaagaguggccuuaucauugcuaccucaaguagggacuuuacccaaggucaccaggcauuguacccucuguggguugagaagcacaucgggugaauuuauccauuguaguauuggauaaauacuacccaccuguuucucugcuguaaaaagccacuacuuccuuacaggcaaaguucucuuuuuuuuuuuuuaagauuguacuuuggaaauccauucaaaaaauauauauaguugaauauaaacacauaaucaccuuuuuuuuuauucuggaauucugcucucugauaucaagggucugucuuucuaaggaugugggacuaugacuauaauaggguguuuccuugucacuagagugacaaaaguucucugccuuccagagacauacauccaacauagcuugcucccuggaaaaugauugcuuaauaacuugagacuugcucuguguguguguguguguguguguguguguguguguguguguguaguguguauguguauacaugcauucuugucuguauggguguacauacauaugugugugcauggcgaagaaagcacacccugggguauuauuccucaggaacagaacagcauccaucuuuuuuacugagacaugaucucuuacuggccuggaguucacugaauaggcuagacuggcuagccaucuuaccacaaggauccucuugucucugcuucccagguacugagaucacaaaggcaggccacugugcuuucuauauggguacuggaaaucaaacccagacccucaugcuugcacagugagcacgucacacagugggccauccccccccccaccuaggcucuggagucacuuuauuaguuuauuagcuuuagaaggugcacuuaucuccagugagccauguuccauacucagcuucuaccacgagccacugcuugcuuucuuacuccuugucuuucuuccuuacacauacauuauuaagaagaauaggaagucaggggaguuggguauauggcugguaugccuagcucuuauauaggugguagggauuugaacucagugucucauucauaugcaguagcugcucauaccugcugcacaaucuucuagacccauuaaaagauuuuucagucaguuccuuuugaagugcauuucagcaacaaggacacuuucauucuugaagagcaccuggcuuuucggguucucaaaacaguaagauuuguggaaggugaauuuugagaugccuggccacagguuucacucuuccgccccacauaaugaaccaugagguccuccuugaaguauucaguuguuuuggagauuaauagcaaguagaaaauucuggggagcauaauaacaauuggaauuaaauuuucaagggaaaaauaauagagauauuggacuaucaaaaugcuccugguucagaaauuaaacuuuuguuauaagcccagaagccaucaucuugauucuggagcucauguuaacgaugaaugauuaugccugaaccuguuaauauuuaacuuuuuaaagcauuauuuuccugcaaguagagauucaaaauaccuuuaauuacugccucugguuaagcccuagggccuacagugcagaaccagccagaccauagagacaaauggucugcauucugagaguuuucaacguuacuuggcuuagaauuucgacaguuuguuucuuaugugguaaagcacagcuaaauugcuuccccccaucuaggcuguacgcgcuuugauccuuguguucuggacuugccuugcuucguccucacucacauccacuucuuucucuguguuuuagucuaauccuacccaacccugaccgccgccuccuugucauuuacauacaguuggaaucuuuguguuuguaguuagcuguuccucuuuaucuuccauucuagaagccugucaccccugaguggucuguggucaggcaugcugacuugauggccucucuguucauucuagaaccauuuacucuacuuucaccauauuguccccuugagauaagaccggaggccauagccuucuguggaucuugcaaacgucacggcuucagguuuuacuaccguuccugcagccgugaagucaaacaugaauugcggcacgcccugccgcagcuaggaccaaaagugugaccuuggggaaguucuggggcuuugucuccaccucagguccugagacuucccucccacccucccacccuggacaugaaagaacccacccccuuuuccuuaaggggcauccaccuccaacgcuuaaguugcuuaaguugcggcagugauaagacaaaggcaccaaugacuuuaaaaccucuccacagaaaacaccuuugaguuuuagcuauacguaccaguuguuaagauaaagagccucuguguguauaucagcuccccuguggacuaagucacccguuucuccuugagggugacugcaggugagucagaaagucucuucuacuuacauugaagcauucuaauuauuuucaucuaacuguacuaaauuaauuaauaauauuaauaauaauuaauaaaauuaauacagucuaucgcuuacugaauucuuuuuuuuuugaagauuuauucauuauuaaaucuaaguacacuguggcugucuucagacgcaccagaagagagcgucagaucucauuaaggaugguugugagccaccaugugauugcugagauuugaacucagcaccuucagaagagcggucagugcucuuaaccacugagccaucucuccaacccccacuuacugaauucuuaacccuucccugauagucuguaaaagugagaaugaucagaaacacccaaagcgaaacaggugaccaguugucaacccagcugccaccauuccugggcagcggcuccugaagcccccauauugacucuuuaauucucagguuuacuaauucuguaaaguaaaaccguaucucuaguccaauucaugaucacugaacauucuuaacuuuuuuagacagaaacaaguacagccuggagugcucguuuccguuaugugucaugcccaguuugcccuuuaccuucagcuauaugcuaacugguuacauguacacaccgauuuuuguugugucguuaagugaggcuuuggguuauguugaucauuguuugcuuugaaggcuuccuucaucggugaucuuuucagccugcccccuuacuucucagccuuggagaauaacuuuacagccacuguaucuguaucucuccuuccaucucucuccucccucccuuuacccucuuucccgcaugccauacgcuuuucuguauucaaaaugugaaauugcaccaccuaccuuagauuccuuacucuauccuuagccuuaaacauggaacauaguuuauaacuugaucucagugcaaaccucagcuucgucacguuaaauugaccugcuggauccucuugcauguggccuaccuuacaguagucuugauuaauaagaaagucauguuugcggcauccgaguggcuugugggugcaugcguuauaaagaaugcuaacguggagagcagccagggauaagcuuggucauaaagagaacaucuuaacuggucguauguccagaaaauaccugcuccuucugugggcuccgucaggccugggcugcaggaguucuaaagggcagagucagcagcccugagcuguuccucugugagcacgaagcagcccuguggaggcagaauacaagcucuucuuagagucugaacugugcaaguguuggguguaaggcccucuaggaaggcagguagauguuuaaccagcuacugcugacuuagguguuacugagugcuauuguccgugcucugcuuacaaaacuccaugccauuuuggugggcugccaccaaccucccuugauucuguaugcccuucuuucauaggcuagaauucuugcagaacacugcaguucuguuuuguuuuguuuuguuuuguuuuguuuuguuguuuuguuuuuuuguuuuucagaacuguauagauggaauuagagcugaaacaccugagccagugucacaguugaggaaaugaaugaauuaacauguaaaugaggaaggcuuccuccugagcuuuaagcacaguccuggacaagaaagaaagacuggguggguggcuuuuauuucuccguccaugaagacccuuguuugaacauacagaggagccacaacucagcuucacaaggugaaggucaugcuuagguucccagagggucuaauguugaagaagauggaggguugugccaccaaacccuaggguaagacauguagcacaagaagaugguuagaguauguguucaggacguaggucagagcaaggcagugggacaugagaccaagagaauauugcauagagccaaugcuugcauugugccagaugcagucgauguugaauguucaacaaccauuggcuuugcuucucugcugcacauuuauuuuucuucagcaaguaugggauauuuagauagacuucucuaagagcugguacaugcgaaccuuuggcuuuuuaagaauagaauugguaaggaaaugagcaaaauuaaaauuaaaguauugauuccagaauaaauaagaacacuaauggauaauuuaaaaagaauaaggccuaaaaugaauggaaucuugcuauaugacaaggaaagggaaaagagccugcucugguggguauuuccacauagaaugacauugaauauagcagagucuauagaaggucuucuccaagauuggucaggcaaugccuguaaucuaaauucugccuuccacuuguuuuuauaaggaugccuucacgauauugcugugccuaucuguucacagauggccaagagauguucuucaugauaagucucuucuccugcugacuguucucuacugauucucauaauauguuugauaagucaauguaccaaacaaauucuuauugacugcaaaugguaugaggacaauguucuuuuacugaggauacaaauagcaaauagauuuugaugucauguuguggaacucagugguaacagaggacauaaaugcuauucaaauaaucacacaagugaguuuguaguuucagauuaucuggcaggcaagucccauagagcuagugauuggaagauuugugugaagagccuagagcuacugaugaggaacuuaugugcagagaauggagauaugguacuauuuauccauaugcagagucagagaagacucucccauguucucuugucaugggaagaguagguagacuucagcuuaggaaagaaauauaaaaagggaauuuuaagccaaagaaaccaugugggcaaagucccaguggcaagaaggaacagacacaggacagacagcuauacuuacuauaggguggugguucucaaccugugggucaaauggccccuucauagaggucacauaacagauauccugcauaucagauauuuacauuaauauuuauaguaguaacaaauuuauaguuaugaaguagcuacaaaaauaauugguuggggauuaccacaucaugaggaacuaucugaaaacaucagcaucaggaagguugaaagccacuguuaccgggcaacauugacgggaagagaggcaaauuagaaaaguggagaccuugaagauaagauagagaaagccauuggcucuagagccaugucaaacuucagcaacauaucugggcucagcagcauaauuaauguuucagccguggagagagauguaggagagcacaugagcccugggacucuaacccaccagcagagcacagggcagagaauagagcugccaacaagauguagaacccaggagcagcaugcagagagccugaggugaugggaaaaugagaagagcaaaugaugugugagaggcugaggauuagacaggaccacugaguugguccuugccguggucuuuccacacaaagcaggcugacgaaagugcagcugcaaaaugauugagggguuaaggagaagaacuggaaacaaguauguauucauucuuuucuucacucacucauucauucauucauuuguuccacaaaucaucaucauaugaacauuauuuguauauugggagucuaaaggugaggaaaaccacuggaaggccuuguuauccuggggaucucggguaagucaggagauggucaucuauucaagucucccuaccaccauccaaauugcugaggggucaauaaaagcuaugguaaauggcaaaaggugugugggaauauauaacacagauggaaagaguugagcagaagcgaucaccuauggacucuggagcugaaagaggcauagauauuaaguaugugaaguuuguagaaaacuccucucaagagacugagcaaagcuggugccuguggggucagaagaugccacacucgccaagguggucauuaagcagcaaauccagagccuuauaaagcaauuuaaugauaaauaucuuuguccccacagcagugggaaacccggaaagacaagggcagccauagcuagcaacuuaaugauaaaugucuuuaucccuacagcaguaggaaacccuggaaaggcaagggcagccauagcuagacuuggagguucaguggaguauguuuguagagagcguggaccuacugcuccuuuuugaugggaucugagcauguggucauugaaaaggcuucucaucugcuuuucauuauagugucaucgguucgaugcacucuuaaaggcuguuuugauagaacgagguuucuuuuggaaccgccugagauaaaauucuccugugagagaauuguauccucuggauacugugcaaguuguuauuguaggagccauggcuuucuaggccuacuagugucaggagaaaagggggaaaagaaaccaggagacuucugaggggccugauuuucagugaguuuaauuuuuauuuuauuuucuguauauggguauuuugcuugaguguauagcuguacaccauuucaugccuggugccuguggaggccauuagaggcuguuacaucccccaaaacugcaguuagaugguugugaguuaccauguggauguuagcaauccagcccaaguccccuggaagagcagccagugcucuuaacagcagaacaacaucuuuccagccccaaggccacugacuuuaagugaaauuuacaucugaauguugccuccccccagcucuaccccacucccuuugaaagcucuuccaguaacucucucugcuuucucucuuuucuguccaaauuugaggacucuuacuuacucacucacucacucacucacgcacucacucacucacucacuuacuuacuggguuccucccaagguuuuugcauaaaggacuugaucacugcuggguugaggcagaaagggaagugauggauuuucccagaagguacugacaggcccgagcuggggaugggggagaaauugccucagugucaguggaaggcugggccucacugcucccagacaaggcucaccuaucuacccucuggcugcugacucgaucgcccuuucuuuccuuuccucccccucccucuuuccccucccucuccuuuccuuugcauugacaauaaguuuucuguggaaaaauuagaaugugacaggucccuguugcugaucuugcccauacucuguuucuccccauuuguuucaagagcaucucauuaauuaguuuuuacagaaaaaaaaauguguggcacaauuaguggaguuucuuugccuuccuccuggcccuguuaacuaaacaccucccacauccuguucucugcucccaaccugauugacucaugaggugacacuggcugacuuggcaagucagugaccuucuuuuggagcuagaguugacagagcugauaggaccagagagaguaggugcucagucaugucuccacugcagaggaagucucucgccuuguucuauacacaguucugucuacaauuccugaauuuguuccuacuaaauuacaagauuuaaaaacaaauauaaccccgggagagagguaggucgaaauacuauuaaguaucagaagcaacccuuuguaaucuucccagaaaugcuguuuuaauuuuaaccuccccucugcccccaacuugugagggugaaaugagauaugugugaggcucccuuaagcuuucuggaugaaaguugccucagcuuaacuuuuuaagauuuauuuuuaauuaaaaacaauugugugugugugugugugugugugagagagagagagagagagagagagagagagagagagagagagagaggcagagagacagagacagagagagagagagagagacacacagagagacacagaaggacaaagacagagugugugugugagagagagagacagagagguaggugaaagggggagagagagaggaaggagagagagagggagagggaggaaggaagggagagaaagagagagaugaacgugaguacaaggacccucaugucagaagcguuagauccccuagaacuggaguuacacaacaugggugcugggaauagaaccugggucccuagaagaacagcagagacucaaucucugagccguuucuccaggccuggcauaaucgcucgucugagacuugggcuuuugcagugagcucaaccaguauccucucaaccauaaaagaauuauugauugcagugauaggaaucaauuuaguuuuugaaaagccugcaauauucgaagaccuuaguucugcauuacaaucugcagcacuuaucuuuguugagaguaguuuaaaaugugaaucuuguauuguuacuaaugcaaauguuuuaggucuuauuucccccugcuccuuuaagacaaggacuccuguaggcugggcucuugggcuuggucuuguuauguaggugguagcugaaaaugccugugauuucugaucuaccagccuuugcuucccaggggcugagaucauaagcaccaccacacccagcagaauauaauuucuuuuuuaaugugaaguuuuuacuauuucuguccuuccaaggauuccauaaguuucauagauuuggcacagucuuuuucaauuaugauggaagccuuggugccguaaaguucugaccugccuuucgcccaugauccguuccccucucagccccacaguuuagcuuucuuuaagacugucucugucagaaugcauuuaaaaggaguagaguuggcaccagugagcuuggucugucuacuuuuuuuccuccccguggcuuaucaucucauuucauguuugagacaggauagcuaacuggucccaaccucacaguaacuccauauuuuuauguacauuauaaacaggcuaagacaccaacuaaugcaguagaauucugagcaguggcauuuaaaauagccuugccuguaugauucagaaauccauaagaaaacuuggccaauacuuuaaacaucuucuagaccuguuaaaugcugacugcacccuccccucccugacuucucccuguguaggugauagcugacucuuuuaguccacaauacggguaccaugcaaguggaaguagccccuacugggacuuguccucaauuuugcauacccgagugagagugagaguacaaagggagaaagagcccuguccagucaggcaaggugguagcauaggccauagugauguaauucauuccauacaugucugauggacauuagaaaguaaaaugaguauggcgcccagcaggaaaagcuggaccuuacuucuacacuaugucccccauguuguuucucuccuucaccucuucuuuuucuccccuccccuccccuccccuccccuuaguguguguguguguguguguguguguguaaucuuuugucagccucucaggcccacucagguuuuccauuuauacaaacccacaaggccacagcagccagccccauacuuaguuagagucagugcaguuugagcuucuugagagcacaggcuguguguguuugguacccgacuguaucucuagaaccuccaggaaaacaagaaacuuccugugagcucagaaaaauccucccugaaguugaauccaucccucauucuucaccccuugguuuucucaugugaggaaggaccuggcuguccuggcuguguggaugaucgaugucuuccuccucagcaaggguuacacugguggcucauagguuacugggaucuaaaauagaccccuuugaaaaccagccugcggcuauuuuuugacuauauguauacaaugcucuuuugaucaucagacaaaaauacuacuuuuaauuacuguucaguugguaguuacaccccuagacuguggaaugcugucaugguucugugcacauucaggacuuugugucugacuggguuuuauuaacucuugucauugacaguuuaagcuauuuacucgaaauugccucugaaccauuucaaugcauacuuuguuuuuagagaaaaugugaaaacacccucaaauggguucaaauuugaaaaucaaaauaaguuacauugcuuuauuuuauuuuacuguuuuuacaaaaaaaaaaccaacagugcuauuuucuaucauauuucauuguuucuagcuuuauuuguagcaacuuuaaacuguggauucagccaucuaagaauguaagaacuauaguuuccuucuuagaguuucagcuucaguugcugugaggccauggggugaaaauucgguauguggcucaggagcagguuuucucuagucuguggguugaguuuguaucugaggauggugauuuccaugcuaacuaauaucuggggugcucagcucuuaaauauaagcuagcuaggaccagaucuggaacuugagaguggcuuacucucuggagcuuuacaaaaauuccagauaggucauacuacagaacucccauuuuagaauauugaauggaggaguucagggacaucaugugaguuuucuauuggauuauuguuguuccucuaugcugggccagccaucuugccaauggauggucaugauggaaaacagguaagaguauggacugggagaucuuggucuacucgacuauacuccauucaucucaacuaccacuaagacgagacaagauaaaacaagacaagaccagaccaaacccagccgacuuuuaaggauggaaagugaacuuucugggaaagcaugaggacuuaagcucagaucccaacagugcuauagaaaaccuagcgagcgagcauucccagacacauacagagcaaauacaccuccacccaggucauagaugaggaaacaacaagagucaucucgaaggguagucgcacuacuaggaccagguagcagucuugucauuggguguuucuuuuuucaccuggccucaucugaccuuuucaaaaugaguaagagacagaagaggggcuguuugguugcuaacuaauugcuagucagucgucucucccaguaucuguuauggcuguaaucagaaacacacuuccucucuguuagguauggguggccuugugcuacgcccagguuuggcaaguauuuagacagcuuggaagcaagcggcacagggaucagauggcuggggucccuacugugcuguucccaggugcugagugaucuuagaaacaaaauggccuaacugguaagagcccuugcuuuccuaccuguccuaccuggggaaagcaguguuucugagccggggcggcuggagggugcugugauacaauguccauguauggaugaauaaagucaucacauagcagaugucacugucauuauccucauucauaugaguaccaacuugcaaugacacuggaggaauaaccugcuguguucagacugaagccauguuguuugucacuuuucaugaauuucuguuccuguuuagaguaucugagaacuuacuauauuaucaugagagguccaggcauaggggguauagcuguaugcaagagacaaagcauaaauguugaauuuagaauuaauaucucacugcuuuuuaauuuuuuuagguuuuuaaauauuuuauuuuaaauuuuaauuaugccucugaguaugugccugucuggcugagccugugcaugugugugugcaugugugucugucuguuugcacuugagugcaggugccuguagaagccagagguguuagauccugugcagcuggaguccuaggcaguugugagaugccagacauggguacugggaaccuaaccgagguuauagaagaacacaaaugcucuuaaccacuaagccaucucuuaacucuuccuugccguugcauugacccacauuuaacuacaccaaagcugaacugacagaggugaucauuuuuagguuuugcuuauuugccuguccaccaccaaccacccugaagucaaccucagaaaugcugugugcuccaugugucuguccuuacuuaacuauuuuuuguuuuucaauuuagaagccaucucucuagucuccuacuuggucaaaucuuauuuuaccaaugaggcccaggccaacuacugcuucucugugaggcuugccuuguuuacuucuucuucucacucuccccuuucauagaauaguagugcuuauaugacuauggucuuugacucuugguuuuacugagaucaaauucaucauggaaacaaguuaagaggagaugcauuugacucaguguuucaugggcuacuccaucccuuaggguaggccaggcaugguggcaggaauggacaagucuauugcagcaggaaugugugaaucaggaagcaguaagacaacugaaguauacuagaauugaccucaaguccuuccauguuccuaagcuggacccuacuuggccaaaagccuaaaaccuccccaaacagugccacuaguucagguguccaaauguuuaaacacaagaagggaaaguugaaaccauaucacugucacuagccauucacacuuuauacauuggcugcuucuguccuuacagacagcaagaggcaugagaggauagucuauauccauauugucucugcuccuucuuaggaugccccuaguuccuuuuauauagucauggcagcacuguugagacagacauacauacaggcagguaggcagguagguaggcaggcagagaguuauuuucuaagaguuauuuuccucuuuuguccccuuuaaaaggagagugaaacaugucuacuucaugaguauaccuguucaugacucaauacagaugaauggaaaugcuagcacauuucugauaaucacaguuauuaguguuuucaaaugucgaaagugugaaauaaucaugaugaccaaggugccucuuucuugcccauguuucccucccagcucaacuuuucucacuugucuguagauaacuccuauuugacuuauuucacuguagauuaguuuauauauacuuuagagaggaggguccuagaaucccucacuuaguuccauuaacuugagauucagguauguaaugguacauaguaaugucuuaaucccuuguauuauuaaauucuauauagagguaccccgacauugguuguccauucccucuuauggauacugggcccugcuucuaguucuggaagaugauaaauuaagcuuuggucaacagauacuugugagacaucuuucauuucucuugguaaacaccugggaguggaguaguccagaaguauaacugaaaugugcuuaacguuugaaggaagaaccccacuucauuuuauauuaucagcagucauacacaagauuguauacagcacucauuuucuuuacaucugauagucuugcugaacucagccauguccaucaucugaaagguuuguauauuauugguggguguggacucuaauuucacugggauuguacuuagcaucucucucuuuuuuuaauauuuuuauuagguauuuuccucauuuacauuuccaaugcuaucccaaaagucccccauacccucccccccaauccccuacccacccacucccacuauuuggcccugacauuccccuguacuggggcauauaaaguuugcaaguccaaugggccucucuuuccagugauggccgacuaggcuaucuuuugauacauaugcagcuagagucaagagcucagggguacugguuaguucauaauguuguucuaccuauaggguugcagaucccuuuagcuccuuggguacuuucucuagcuccuccauugggggcccugugauccauccaauagcugacugugagcauccaauucuguguuugcuaggccccggcauagucucacaagagacaguuauaucuggguccuuucagcaaaaucuugcuagugugugcaauggugucagcguuuggaagcugauuaugggauggaucuccagauauggcagucucuagaugguccauccuuucgucacagcuccaaacuuuguaacuccuuccauggguguuuuguucccaauucuaagaaggggcaaaguguccacacuuuggucuucguucuucuugagauucaugcguuuagcaaauuguaucuuacaucuuggguauccuaaguuucugggcuaauauccacuuaucagugaguacauauugugugaguuccuuugugauuggguugccucacucaggaugaugcccuccagguccauccauuugccuaggaauuucauaaauucauucuuuuuaauagcugaguagaacuccauuguguaaauguacaacauuuucuguauccauuucucuguugaggggcaucuggguucuuuccagcuuuuggcuauuauaaauaaggcugcuaugaacauaguggagcauguguccuucuuacugguugggaccucuucuggauauaugcccaggagagguauugcgggauccuccaguaguacuauguccaauuuucugaggaaccaccagacugauuuccagagugguuguacgagcuugcaaucccaccaacaaugguggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaggugcuucucugccauucgguauuccugguaaugaccuucucaagcaccuacuugcccucugcaagucuucuucuaaugaaguauuuguaaauaaugugcucauuuuuaaagugggcuguuggauacaguuccuugccuuggcucugucaagagcaugccauauguuuuagcugaguuucaucuuuaaucauguauuuggaaaaacaagaguugucaacaaggauagaacccaauuuguugaugaguuccaccauuaauuuuaguuuuggugcuguguaaaccccuuccuuaacucaaguucaugaggaucuucuuuguuuucuuguagaaacugaauaguuuuagguuucuugagucaaugugaguuaauuugcacauguuguaugauggacauaaaaaaguuccuuguuuguggaucuaguauuauucuaacaucgguuuccagagacccuuccuucuccauggcguuucccuugaacuuuguugagaaucagugcagccaggaaguccauuagccacagacuuugcacuuuuuugauacuuucuucuauaugaucucauugcaaauugcugaugaaaaaucugguauuauguagagauuggacuuagugaaucaaaguuguugaaguuucaguuuugagcacuuaaguuuagguagacaaucugcuuuaaugagcuuggaccaaaguggcuaucuuuucaaaagguggcuuuguuagggagaaggcucagucaauaaaacguuacucuguaugaauaaggaucugggcuggguucccuagcaucaccaaaaaaguuggcuauggcagcucuugccucuggucccagagcuggggagggggaaaucuggaacuuauuggcuggccagccuaacacucuugucaguuccaggccaagugagagaucuugucucaagaagcaaggcagaaagcaacugggaaagacacuagauauugacuucugguccacucaugcaugugaaaacacacacacacacacacacacacacacacacacacacacacacacacaccacgcggauuuuucuucaguguuauuuaucuacugaucuuucuaacucugaggauaacuuaccagaaacaguccuugaucaugagaauaagcagauuucugugaauaggguaugauguuuccagccaggugugguggcacauaacuuuaaucucagcucucaggaggcagagacagagaagaggcagagaggcagagaggcagagaggcagagaggcagagaggcagagaggcagagaggcagagaggcagagagacagaggcaggcagaucucagugauuuugagggcaaccuugucugaauagugacuucuaggucauacagugccuuaucucaaaacaacaaacaaaauaaacaaugaugaccaaaccaaaccuaaccaaaccaaacaaaaccaucccguauuucuguaaggcuuaaugggaguuuuucacuacagacagacagagguuuaguagcaguaaacaugaguucugagaugaggaaccaauaguuuucgucuuauuuugaugguguuaucuuaggagcugaugaaacaaaacaaaccuccccacccuuucccuucuaaaguccuuuuuuuaggccauuucuugauauuugcccacacuuuuugccuuuuggucuugcugucuaaucuagggugaauagagaugaaaaaauaauagaaauggucucagcguguuugggucugucaucccaacagcuuugagaucaugaccagauuuuauaccaggucacacagcgagaaaaaaaucccaaaugaacucugaaucccugggcacaggaagggcuucuuguuuccacagcaguuacaaaugaccaagauaccccacuuccuccuuucccugaugaaacuggaaauacaaaaaacaaucuuucauaucaccccugcccuugucugaaguuuucaacguaguaauuucuuuuccaccaucuuuucccugauuuauuuuaaaaaguuucuuuuuaauuaguauaaugaagucaucacucucuuaaugaguccuauuaagguaacaguaccagggccaagagaauggauugguggauaaggcaguucuugccaaagcaugagaaguaaaguuugaguccccagaacccaugguaaaaccuggcagguguauugucugccaugauacuaacacucuugggacagagacaggaaaaucccuggggcaaccugauuagcuagacuagucagcaauauugaguuccugguucagaaacagauccuaccucaauaaaggaaguguaaagccaccaagaaaggcaucuagcuuucaugugcauguauacacaugaaauauccacugauguguaugccuauauacaugcaaacaugcaugcacguuccauaaguauguaaauaugcaaucaaacaaaauacaaaauaacauaaugugaaauaagcaauguaaguucuuuccuuuaauucaccacauugauagcuguauuugugguucacuuauuacacugcagcuuacauugaugugggaaaacaaacuguggcuugucaugugguuggugguguaauuuccugggaaucuggcaaaaugacuucaguggauuuuacaucuuuuuaucugguaauugcacuuaggauuuauuuuucuccuuggggacaaggaguaggcaauaaucagagagucacauaaguucuuaagauuuguaucacaguuaguuccuuuguacaaacaguucugcuuuaaauugagauaacguccuugauaaagcuuguuuaauaugaaauaaggccuuagggaaauaugucuuugagucugauggcaguaggacauggggaaucuucuuuaccaguucuguucaguuuuuaacugaucucugggaggucauguuaaaaauauugacuuaaacaauaagcaggcuauagaaaaacaguauagcuagcacgaauggcagauaggagauuagaaccccuguguagcaauaagaaagccauggaauguauuuagguguguguguguauguauguguguguguguguguguguguguguguguguguguauaauauagaugcucagcuuugccacuuguuacaaaaaaagaacaaaaaacaaaagcaaaaccucagucucauuagaaauuaggaaaucuugcauuuaagcuauagccagauacugugcagucuggcagaacuuagaaugugugauacauauuuggugagaacugggacaucagaacauaccucucagauacugccugaaggaucuucauugaaaagccccucaggggaccauuuggcaacauuuaacaaagcuuucugcguagcaucccaggagcuggcaauuccacuucagagucaggacacuaaggccacucugaaggagacacgcaggaauagucaccccagcaucacaaccgaaguuuacaaccaacgcccguuaccuucagcauccacuaggaaggcacaacuuucauggaacagagagaaacuaaaugaacugcacagggaccauaguggacaaacgcuugcugauguucaguggcagcauguugguucaagcauucccauggucaauacuuacauuguguuaacggaaaagcacauaaaacagcaggcgugucacagaaugagaauucuaagugcauacacccuuggggcagaugguugcaaagcaaauucuagaugagaguuacuuaggagaggggcagaucgguacuugagggaacaugguauucuuguuuccucuaaucuuuacuauaaagcaaacauggaaagauuuaaacuuuuucaccucaagggacaguaaguuauuauuuuuguguaccaauucuaaaguuaaaaaaaaaaaaaguugagccggucagugguggcacaugccuuaaaucccagcacuugggaggcagaggcaggcagauuucugaguucaaggccagccugguguacagcgugaguuccaggucagccagggcuacacagagaaacccugucucgaaaaaaaaaaaaaaaucaaacaaacaaacaaaaaaaaaaaguugaaaguccuuuaaagaaaacaguaacaaguuccaccgccaacccagacacuggaagaauguugucaggagcucacugucugguugcuucauauacuuccuucugucucuucugagacagcuuugacuucucucucacucuuuucccuuacccuauguuauuguuuacauauuugugugugacauauuuuauguguacauguuugugugcaugucugccagaggucaauauuugucuucaucgucugucugcaccuuauuuuuaagaaaggugcucucauugaaccauaaucuuaccaauucagcuccaguggcuggccaaugaguccagagagccucaggccuccucucccucuccagcauuagccuuacagguguacacuggcauuuaauggggaugcuggagaccagggcuuaagccuccaucucuguauuuuaccaacugagcugucuucuccgcuccugagauuuuuuuuuccauuuaaauuguuagaaaguggcauaaacuuauagcaucagauugugaaaaugugacucagaggggcaguuggcucuucugugggugacaguguaaguagaauagucuuugugaauauuugaggccagaagacaacuugugggaggcccuucucuuccuucuaccuugugggucuuggggauugaacucuagucacuaggcuugguggcaagugucuuugccugcugugucaucucacagacccaaacauuaaaauaaucaguacuacuauauauauauuggauggcagcuuuuaaaaagagagauauucauaggauuguuugugucauuacuuaccaauaaucugaaagaaagucuacauuaugugacuggaaacuuucuuuaaauguuuguaugucccauauguuguuauauuuuaucuaauuauauuuccauuagccuugaaauaagugcugaaaauauauacaaacucuaaagucacaagaguaaaagaagggggccauuuucuuugcaugcaucagcauuugccuuguuuguagauguuuuacaaaauaagcuuucaacauuguuucugaauacuuaccaauacucaaaugacauuucugucuaaaucaaugaaggaagcaugucauguauugcauuuuauagcuugugccacaauuuccuccaggagacaaauuuuuccuugauagcucacaucugcaauuguaagucuuggcaacugucgaggcgcagcuaaggcaguggagcagugaugaugauauguaguugagguggcaugaaggugacucagcccucagcccucgagaugcucugucaucagguguagugauugacggcaucccaugugugaccgugccaucggcugccuuuggcuauagguaauaguacaguccauugaauagaguggagagccacuguuccauagagccaccguguauaaacuaagccagugguuuuacauagccccaacaaauguguuaauagcauaauaaaacagcccccccccccgaaucauugcauggggugucuacucaaccuguccauauucaggacaacaggaagcuauaacagcuuuaggguagagaucugaugcugaguuuuacuaacugugacuugggggauugcagcacuuuaaacaagaaggggaauucuuucucuuuuugaaaugagaccaacaugaauauucucgauaaaaguuuuuauagccuuccucauguucaucauggcuacccuccucucccaaccauuuacuagaacgacagguauacagauauugacuuuccaucuacaugugcacaucuguggaaucuugcuguuagaauuaaaagacaaucuccaaaaauugugcaauggucucaucggcauaaauaaugaauguuucaugaggguuuaguucauuggucugcucagugaaaauucuccacagaugaacuugauacucacuguguccauauuaugugucuuuguacagacucuaacuuuggacugcguugcccacuuaggcggaaggacuacugaugcuuuccuacugugcuggaguguugggccaguagcaucauugugcaaugucagugaacacuggacucaaugugagagcugccugguugggagagcccaagcucaacucucuuuucagcccaagaccuuguuuuuucuugacuuuccccuuuagacacuaagaucaguucuacucuaagaagaugacccaggggaaugaaugggaggggcuuaugcugaaaauccaaagucaacucaggacacuuacaaacccagccuuugaguagguauuccuggaacaugagcugugagcagcagaccaugccagucaugggaagugccacuggcugcugaagcugaggacauaugccccuucacaucacaguggacucugcucuguaguuagcaucugugcaauauauagauauaaucaaacauggccgaccauaguuuauacccaaauuaugcaaagauacuucuggccuucauaacuuaaauuuuuagaaucuuauuucauuuguuuccauugugaaggaauauaagagacacaauuuauuugaggucuuccagaagugaagaauucauuucuacacuaguguguauaggauaguccauuuaaacucaagaagcauacauuauuauaagguguaauaaaaauaacaaucauaccauuugguucuuguuccauaucuuaguacaugaaaaugaauuacuacuacuggucuuuucuauuagauauauugagaaagcuauuuuuauauuuauguauuuagauacauaaaacccucuauuugcacauauguauuuaaauaugcacauuuauagaacacauacuaaggacauaaggauguaugaguuuauagaaucaaccacaacccuacagcagauuuuuugauagcuagcaaugauaagcaacuguaguuauuuugaagaaaauaacucuguuacucugugggaccaagaauguugucuugccuggccucacuaguuccugcaucuuacagucuagcguaggggcucagugugagccuuugguugguagaaccugaguccugugauauucccuaguuauaagggaggcugguaaagaaacauguuuuaccacuucuguaaguggagguguguucuacagccaaaaagaaaaauuaucaaauugugauuccaauauuuagaucagaaaguuaguaaguuagggaugaaaauaacauuauuuuauccugauggaaaacuauuuuaagguagaaaauaauagucuuuuucuaguuuguacauugauguauuguguucuuggacaguuucauauauguacccaaugaacuuuaaucaugccuguuauccucucucacccacuccuucauccacuaagacacgucuccuucccagcaaguucccuaucacuuccacaucuuauaaacccucuaguuuaguuagguuugcuccuguggaccugggugagaggcugcuuaacagagcaagggcaacuuaucaacuuagaccacuaaagaaagugaaagacccccuuucuccaucaaccagcaacugccaguauuugcuuauggagaguuggaaucuguaaagccccuuucucacccaugaagggauuguguugggccugcuaucagguagguuuuauguagguaaugaggucaggagugcaaugaugccagucauguccagaagucucuuugcgucaacccccauaucuuccagcuccucaucuuuuuaguuucucugacauucccaaucacccugccuuuacuuuguuucagcaguuuggccacuuugagccucuuuguagccugcugccauaagaugcuugcuucauagaucaagacugauauagcacucaucuauggauaauggugugagaaggcaccuggccacauccaguuagugaauaguaguagguagguagguuuacccucuaggccuauggccuccuuagccuagggcuguugaccaggucacaccagagugccaugcuggcuggcuuccucaauuggccuccaccuaguuuucugaggcagaaucuuucagugaauguggagcuugccauuuuggcuagacuggcuacacaauguucccuggggaucuacuuaguccuccaaaaagcacagcaguaacaaaugucauaucugggugugcucuuagagauguccugacuguuauucucucugugggucauuucagagccuggcuuagcauuuuuauauaaaauugcuaucuaucauuuaucaucuaucuaucuaucuaucuaucuaucuaucuaucuaucuaucuauccaucuaucuaucuaucuaucuaucuaucuaucaucugucagucuuucuaucaucuuucuucauuccuuccauccaucucuuucuucucucucaucucucucucucucucccucccucccucccuuccuucuuuccuaguuuuauccuccccucccccuccuacacccccacccacauacacauacacuuccuguuacuguacaggacuuguugauaggaaaucuugagguuacagucucuuguucauagagauaacaucuccacucaagaagacaaaaagucucucucucucucucucucucucucucucucucucucucucucucucucucucuuugccugucaagaugagggaugagauagcccuuggcuaccucaugcuuagauccaggaagaagcuguaucaguuggcccugcagugucugugacuucccugugcauuuucuggaaucuucuucuaagaagagugaggaagugaagaggcagucugugugccaggaucagauucuacaccaggguguuacugacaauggggacagagaauucugcugccagaggcugucuucucacugugggacaucuggcaucaccccuguacucucccacuagaugccaguagcaacccauccauccccacccaguuuugacaaccagauauaucuuuaaucagcacccaguguucuuucuuuggagggcaaaauugcuggaagcuaaggccacugucuuaaauauauaauucuguguggguuagccucuuccaaacccuggaccuagugcuucaauugucagucccuuggggacugaaugacacacuuauuuucuuucacauaacagucucugugugucugcuacacaugauauauaauaucauugggaaacuacuaaaacacugagaccucucuuccucuuccucucuuccccucucugccuuucuccuccuucccucucucccuuggcccucccucccucccuccuucauuuccugugugugugucuguguguguauguauguguaugugugugugugagaguaucuuuguguguguguugguguugcugggauacacauaaguaccauacuacuaugcuauugacuagcucuauuuuuauaaaaucuucccaagcuauauaguguugcaguuuuuuguuuuuuuguuuugguguuuuuuguguguuguuguuauuguuguuguuguuguuuuaacaggagagugaucuggacuuuucuucuccacuuucuuuugauagugguuuucagugaggaauauggcaucugguauuucagagacacaguggccuauuuuucgucucauaaaggacaucacuauaguauacaauauuuuaaccuuugcuuaaaacaaaagaaaucucaugauacuuagaugcacugggcuaacaaacauuucuauugagcuugcacgauucugcucccugucgcccuucuccacaagacagggaagaaaagccgacauccuuucauuacuccauguccugaggcagcucucacacaacacaugugcuguuuugaccuucucugcuguuagucgucuuuguugacccauuccuggcuaggguaacuguuguucuucugguacaacuuugaguuaaugguaaggauagcauuugaaagacaaagguuauucauuuguuuguuuguuuguuuuaacaaguaacacuuuuguucuuuacaagaaauugaauuuuuuccacugagaggaucaagaaauccacagagaaaaugugacucaaucacacgugaaggagggguacagcuguggagccucccgaguauucaguuuuguuguugucugguuguuugguuggauuuugguuuucaaaccaggguuucucuguagccccagcuauccuggaacucgcucuguaggcaggcuggccuuaaacucccagauaucuugccugccucugccucgagagugcugggauuagaggugcgcaccgccgccaccaccugugauuacugagagguuaaaggugaugugauaagcaaccuccaccagcaaacucaccaauauaugucaucaauauacugugcugccaacugugguaagagcauuaauacugcagucugagcuguagucccaacaaaguaauauuucugugaaguaaaaucaauuaagcaguuugagaauuuuguacaugggugcacuauuuacauuauuccucuucccuccaacucaugccauaucuuccccacccccucucacauucaugauucccucuucaauuauugcauacauacauacauauauauauguauauauauaugaacacagccauccuucugaauccauuuacuguugaucauaugcauauuuguuaagggccgacugccguaaagaaaacgaauucuuccucugucagaagccauuaauugcuuguagcuuuucaucaacagagauuaucucauugcauuucccucaucagcacugauauaucaacuaauagaguuguaaagguugugguuuguugcucugucacugauauuccauugguacagacuuccuguuauauauagaagaccccauccccauguugcacguuguguccugguguucugucccuuaccaucuuucugcuuccucuucuucccuguccccagagccuuguguauaagaguuguguuuuggacaaacugacuggacuugggcacccugagguccguuagcuagcuagcuguucuuugcauuucggccaguugugacuuucuguaaugguuuccaucaguuguaaaaaggagcuucuuugaugggacaugaaagcuaaacugagcagggaaagcuagugagcuggguccagacagauuauuuauacugaagaaauaaagaaaauaaucaaagcagguaaugaucaaaaacucucuccaagcuauuuacaaaccagcaaaauuauacugcagcuaugaauucuguggauuguuauagcauagcaagcaguguuuggucaaagaacuggaaugaaucucacuuuucuugucuuagaaauggggauaauaauagugcccauauggcagggcuguggaagaauccaacaguuaaauccacaagucccuaggacaguguuaauucgccuggaagacuugccuguuuguuuguuuguuuguuugguugguugguugguugguugguugguugguugguuuuuugaggcagaguuucucuguguaacccuggcuuuucuggaacucacucucuagaccaggcugucuucgaacucacagagaucuguuuguuucugacuccuggugcuggagaucagucuacacacacagucaacccuguacacugguauuuuauagcuguguccuacauuuauacauuuuuaugggugaaaggcaaucaacuuucugagaugcugcuuugaauaaggcauuaccacuguguaaauguauaaagcugguuuuaggacuugccaaagacagugcaguuccucagaggccaagaccccucagucucaugacacagccccgaagcugcuguuauuacgacucggcuccucuuugccaguuuuuagcucauguggacuugaccuucaaaccacuagcauucagcucucaugucugaggggggcuugcugacugaccuuuuacuuaggcccaaggcaauguuuuccucugugacaaacuugcccacugccaguuuuugaagagcucuaguccuuauguggcagagcuugcugccugguuauaaucgguccuaauacccgauaaacugugaacaauggccucguuugagaggaaauauuaagacaaaaagacgucuaccaugcugaggccgugcuaaacuggagcacacagagaaguuggggcacgugggaugcugccccagcuacucccauaaagagggggaggcucgccagcccucacaauggaccauuauaagggcaccauugaaaccacguaaucacagcccuuuucaaaaccagaaaaaugugucaaguauuagacaaacguaaacugugcuugaaugugagacuagaaauuucauaaauagcagaguccguuuaaucugaucaaauauuucaagagaaaaaaaagaagaaaacaaggcaguuuuuauugcugaacaacaguuuccuggcuugguuuaucauuuguaaaaguuucaaaagaaaagcguuuugccugaauaugcuuuuuauguauuugaauaugcuuuuauuuuugugggguuuguaguuuuuuuuaaaaaauaacaaaauuaguacuuuauauauuacagaaaguaauaaauacaaauaaaacauuacuuauuuauaauugcaacacccagaggcagacauuguaaagcuuucccagugauuuguaaauagauuuuauuuugcccaugcauguguauuugcccaugcauguguauuugcccaugcguguguauuugcccaugcauguguauuugcccaugcauguguauuugcccaugcguguguauuugcccaugcauguguauuugcccaugcauguguagaaacguguugaaguugaugcucuguucuugcuuagguuaagaacuuccccgcugccgggcgugguggcacacgccuuuaaucccagcacuugggaggcagaggcaggugaauuucugaguuuaaggccagccuggucuacagagugaguucuaggacagccaggacuauacagagaaacccugucuugaaaaaaacaaaaacaaaaacaaaaacaaaaacaccccaaaaaaccaaaaaaccaaaacaccuuccccaccuccuuccauaggucuauacaauauggaccuugaggacuacguagugcccaccucugugcccugguucuuuauggggacagcuguauuccuucccugggaggcuucugacaauuccuggagacaucacugguuaugccaguuggguugggguuaggggaugagucuccuggcauguaacauggagaugccagagaugccgcuaaaugccuaacaauauacagagaagccuccacagagaagagucugacccauuacagcaguauccaaguucaugccucaacuaggcacugccucauuauuaaucuaacccaugucucuuguuagauagcuaugagcaaacaacuguuuuguuuucagaaauuaaucauuaucaaguauuuuccagaggacaauaugauaauugugacagcuucuggggggggguacuagguacauuacuuaacucuguugucacaaauagugauagauguuauguuaaugaguagaugguacuuaauaggguggcuacacacuauaguucauguauauggguguguguauguguguaugugugugugugugugugugugugugugugugugugugugugugagugugagugauacaguuuuugcucuaaugggaguauuaaaauuacuguucuuugagcaaaguaauggcuggguagacaaauguauguguguuagccacauuuaucaucuuugugacaaaaucuaaaucaacuuaagaggaaaaaguuugauuugggugcacauuucuuggagagagggauacauggcagcccggauagcuucuugcagaacagccuuguuauaucauggccuaccacagagucuacuguugcaguaaggcuggacucuaaccaucaaggcccgugcugcacugacccacuuccuucagcugcccuggcccucgaaguuccacaaccucccaccauggcaucaucauuuggggacugaguuuucaaauccaugagacuguggggacauuucccauguaauucugugcuuuaguguccguuuaucuuccuuuccguugggaaguuccacccauuugguuggucagaugagauugguaauuugaugugcauugaauauguacuguacaaggucaaagccagaagcaaggaggagagccaagagauaccuucugucaucuggagacagauggaggugguagucccacuagaggguaaaacuugguuaaauucugaguauauccucaagauggucaaugacugcugaugggcuguacagaugauacuugggaaagaaagaugucaaaggucaucaaguugguuggacuaugcagaccucugaccuauaaaaaacagcaguguccauaaaaccuuaaugguacaugccugucuauaacuccaacugcucagaaagcugaggcaggaggauuaacaggcuauggggaguaaguuccaagccagccuaaguagcuuacugagauuuuuuuuaaaaacaaaaccagaaaaaggggcucugguauuacucaauaauguuucucuagcaugaguaagggccuagguucagcccuaguauaaaacauaccacccccacccccaaccccacaaccccugaccccuaccaccaccaccacuaccaguagcagcagcagcagcagcagcagguuucauguguuucagccuucccacuauugaaauagggcagcugacuugaagggcauguuaauugugagcuguuugcuguguagacagcgguauagacagguagagaugagucuagaauucagagaagucuaugacaggcccuuucuagucacaagacuggcuugcuucaccagagcugagaguguagagaguugaaaucaagcuugagccuucauggauaagaugggaagaaggaggaacuaacaaaacaggcucagaagucacgauggaagagagaaggcacauggauugugaccaaguggguaccgcauaaaguaugcggacuucuugcuguggcugcaucacgugaggcauguuugcgccugaggauucuguccuugccuggguggcuccuccugcugauaggccaaucguuaccaacuucagaccuccacuuaaacaccacagcuucucuguguccuuuucuuaaacuucugaaaguuccguuuccugcuucuuagcuggggcaaaagcaaguuauuuguuaaaugaauagagaauauaaaacuuucugacagaagcagguguucagaugaaaaccuugaaguuuaugaagaggauauauuguuuuccucacaugaacugcaugugcaucuguuggaacaauacaaucuguuguacuguuaguaauacagauguuuagacauauucugcccaacacccguggaugcacacucugcauuuaagagcaucccucaaugguuugcucaugugcagccuagugcaucugcauauuuaguaauccaggagugacagggggacaaaugaauaucucuugauggcaacaacugaaaccaaggugcuaaaacugccaaaaucagaucucuuuaguuguuuggauauucauucagaaguuguuuuuauguuaacagcagcaaaagacucaacccgguguugcugaggaguuucccugacagucaucucuuuaggggagaccgggaucuuggcuuuauccccgaaaaugaauuucagaaugaguuacuaugaagcaaaguugggguuugcaaagagguagcauaugcuguagauuuuaaugcacaugugugggguucuagugugucuuaauaguuauuuauaugguuuuuucuuagcugucaaaauuacauuguucaaaggguauaauuuucaaacagagucaaugacuaugcagacuuuuuaaauugaaguuuaaaacaugagcccuguuacguguuucucuuaaaguaucucuccuuccacgugcuguaugaacuauaaagcuuuagggaugagagagcagcgcugauacagacaaacucagaagucacguauggcuuuguccucaggcguggcucuuagcuguucucuccugcuggagagcucucucagacgaggagcguugucuccgcaggcaggcuucucagcagcucugauguuaucaguccgacugaagcucuuucucccuguuuaucuucuuaauucuuaagaguuucauacagagaaacccugucucaaaaaacaaaagcaaacaaacaaagaaguuucauacaauguaugaacaauguuucauauccccaacuccucucaggcauaccuccaccuucccuaauacccaacuuuaugcccauuuuuauuuucuuauuaagcucauuaagucgaauuuguggugcccuuacucauggauauguagccuuccagagcuuaacuucuuaauucagcuagugagaaacacgagccgaaugcaccccagacuggaagacuucuuucucuuuguacaccccuuuaucuuuauagacuuucugucuguuucagucaguuacaagacaggagcauacguagaaacuuugaaggcuauuuuauagcauuacucaaguggcuucauuuggaaauaugauuugauuugacccacucuaagacugauuauaaaauguacuguugggcacacgacagacauuugugaauugaaugcacacaaguucuguucucuauauuuucuaaaaucucuugguauuuaauaauauguucauaugaaacaacugaagcacugaauaaauauaguaaaauuuuaauauaauaauacuguaaaaauuguaaucuuuacuuucaguuuauauguaacaguguuuuuaccagugugcaucauaugcauacagugcuugggacggccagaagagggcguugaccccugggacuggagguacaaaaaguuguggauucucagaauugaacccagguccucugaaagaacagcuaguacucuuaacugccgaacuaucucuccagucccccaaacacauuuuugugaggucucuaaauaucauguauccuaaaaccaaagcauacaucccucuuacuucauaaacaggcacauuuuaaaauaguuuauuaucuaaggaaaacaaacuuacuaggaauuuuucauagagcuggucuggauucuuuaguauaacauuaggaacaaaacguucuucauucuuuguauauuuacugguaccacacugcucugccuccagaagcguagagaguagcagaaaaggaggccauguguaacuacccagaccagugaaucagcaugcaaguccaugucuguauaaacacgugaagaaggcuuguguucauauugcuugacugaaagcaguuggucuuuccuucuuuauucauauauuuuauauauguauauauaauucaaauugaaaugugucucuccaguaggccacucuggcgagagagugaaaccaggucccagcuuguaacccuggcaaguguuugaguuucugauccuuuauacggguaauuaaguauccccuguauucuuucacgggcacuuauccaguuaagacaauauuuagaacacauuaacaaacugaauacacacacauacacacacauacacaacuugaguaauauaagagugcuaacuagcuuccuuggucuuaccauuuuucagagauuacuauugcauauugauuucucuauaaauugucauuuaaaaggcaauaggagaagaguguuacaugacauuagugaacagcggcugauuuagcuuccuaaaauuuauuggaccauuuauuuaaauguguauauugcacacacauauacuauauuuguguguauauucuuuuccuuuauaaaguuccuccuuuuccuuccuuacagucuugcuaaaaugucuaugcaaucagaaaucuuuauucuaguaccuucuauaaaaguauaaauaguucagauauuggcacccuguggguuccucagacccauucuucccuuguauugugguuaauacucagcucugcagggucagcaggaaacgaacuguggacacuaugcaaacuagcgucaggaguguguucuaguaaaacuuuacuugaauuucauacuagcaucagcugucaugaaacacuaucauuccucuuuuguuuucucaauacuucaaaauacaaaauccaucuucaaugggaagguuugggggcaaaccccuaucauggagaaaggccccgggcuuggucaacuugguccuugguagucuuucuuuauucaaguacucuuuauuuuuguuugcagccagcuuccacucuucuccuuuauaccaggauuugucuccauguucccuuguuuuuucuuucuuucuuuuuugucaaggauacuuugguauggaucauguagaaaacaagguuaucuauagcagaccuagagcucugggcucaugguuucucuuguaacaucaggaaugugccuagaaaagauguucagauuccgggaugccucucucucaggcuuuccccaggucacuugagaaagcuaacuuucaccuuuacaauugcacauuguccaccccuggaaacuuccguguaaaaagcagugugcacagaaugaucuuagaguguguaaugaagaauucucucccaaaacacaaguuaacaaaaccuuaauguuuguuguugccuuuuugaacaacaacaacaagucaauuauaaacugacaggcuugugggaauucuucgugguuuuguucaaauucacaguagcaaauggugggggguagaagaggagccaugucuguucaaaugagcuguauguacaguagugagccugggagucagagagcaugaugguaucuguggccaccaucuuacacugacuggagaugggccacagagggaacuaggcugucagugucaccagggaguggcagagcugcccugugguagucaggaaggcaucuaguccaucucugcaaucaguuugugaucguaauaaagaaggcaggagcaugggagaggaaccagaacaagugcgcgugagacccccauggacuuugauguggacggcuaaugugagauacaaacgaugucaguaaauacaguaccgugguaaauguguagaauauugucgccuugucuugugauuuggacugcaaaugcucacacacacucaauuuuuggacaaccuuuuauuuaucugggcuuuuccuuuagagcccuauaagggugggugugggagugagaacagaguagcaucuuucuccagcaucuucaggaugagaagagcaggccauucaggguuagaccuguucacaguggcaugcaauccagccaugauggugcuaccaugcucuacaucagugguucagaguguggucacaagacucaaggacccucaaaguauauacaaguugaacuaacucuauacuaauacuaagauacucucucuccccaccccccucacacauacacacacacacacacacacacacacagacgcguucgacaucuuagaaagucaucauugcuauguuagcaugcauucuucucuuuucuaagcgucccauuaucaugcuaugcuggugaauauugauagaauucacccgaacagcaauuuggaagaacuuaaaaggcuccuaugacaaaacuuuguggccugcccuuucugauauuugaugggccucaucugacacugaaaacaggcugucucacucucugaucauccacauuggugcaugaggacucaaggccuggagaaguagugacuuagucauuuuuacugucugagucugaacauggguguugaguccuuagcuccuuuucugaccguaugauccgacacccaacgauccgggaacuggaaacagugagcucugagcacugucuucccagaaacagcaacuccucucagcccagcccaacuuucaggagugucaguaagaucguguccacagacacugaggcagaaagcauacgcuggcgcuuugcuuccugauuccacuuccagugugucugccuugucuuauacuacgugaaaaaccgaacauuggauuuuuuuuuuuaauuaaaagauuucacuuaaaaauugcacauugucagcuacuuuugaaaaucugggcaacuaagcuguauauacacuggugugcccauagagcgagcaagucagccgcagucugaauucgaugcucagcugcagucugaauucgaugcuccuuuuaggagaaaugaguggccuccaguggccucaguucuccccucuccuuaucaccucauucacugcuaugccccucagucauguuaccuguguaugguuaaugcucuguccccaguguagcauuuucaggcucucuccccaucucccucagccucuccuguaugugcauaaggaggccagaggucaaccucagggucuuccucaguuccuguccacuguuuuuguuugggacagucacucucacugaagcaggcccucccugauaucaaugguguggcuggcccaugaguccagcaccugucugccuccaugaccagugcuguugggauuacaagugguggccugcuuuugacgaugugucuccuggagaugggacccugcuccucgggcuugugagagacgcauuacucaacugaguaccccccccccccccccaggccagaaauguugcaaagaaaauuucccucuacuuccaaacuugaguguaguaaagaccuccgugucagagcuggggagagagcgagucccuuccuuacugaagcauggcauccugauucauuaaaaaaggggggcucugccagugaauuaguguuuauuuuuaaacaugcagccgugucucuuuuaaggggaguagugaaauaagcacauucugcuccugcccucauuucguguuuauuuugguccugucuauugucccaucauuaucgcgucuggacccuuuuacaaaacugaaaaugccugcgaaccucaccgugcgugucaggccagacagguuugcgguggucagccggaaguacuucaguggccacaggauuuugacagaauuaaugaguugcaaauauuugugcuuaaaauaguaucaucccauuucaacaguaagcagcauuuauccuaauuucuaaauauagacuugucucuuuucuaccuuuacuucacccugggcggcaaauuguuuuauaaagcuagaaauuguaccuauauucugacugcuuauggcaaacggacuaugauauacaugcuuagcaugaaauaacaguaaacagugggauggacagauggaaagggacaugcaugcgucaacuguggaucccuggauuguaucacaguuuccaguaagaauuugcaugcuuccuaauuugaggauuagcugagaaaguuuuuucuuuuuucuuuucuaugugcguaugagcccaggucacugugucugucugucugucugucugucugucugucucucucucucucucucucucucucucuguguguguguauguguguguguguguguguguguguguguguguguguguguguguguguauuaguaccccucccccaccaccauuugcugacuucaggucaaaagacagguucugcaucuccuuaauucugaguaagcugucuguugagacucgggugcaagaugaagcgggugagaccggagggugucuucgacacuaaaagucuaucucuuugcagccacacauggcaucauuauuuggccauuagggaagucucaugugugacaguagcuuuuaggcaauguccccucugaagagggcauccagcucuuaaccuauugcugaaagagaaacaccauuguccauuaauacuacuggaacgaaagaugaauggggacuuggccuugaucugacagugagcuugacuuugauagcucauccuuuaaaaagguucuuuuauaucuaugaaaaaaagcaugacgucaagccagcagggaaacugauaucaauauuuaagaccaaacuaguaggaauuaaaaaaaaaaagucccuugugaggacagcuuuuuuuuuuacaugcauaacuaauuagcuuagguuauuauaagcugcugcugugauaacgucuccggcggugccucgggaugccuuguuuauggugccuucuuuaugccggucgcucuucgaauuggaauuacagaaaguagagggaggaggacuaaguggucugcggugucuccugggcuuggggcugccugaaaccuugcuaugcuggaaaugcuagaauacagucacuaccaggugagcauuccccccuguccacaccuggagccugacugcaaggcuauuauauaccugggcuaaucggccucuuuaauguuacugcacuaaggacccgauucgaaauaaggacagaucugcuccuuuaaugcuauuuauuuucugaugcccuaagaaguaauuuacuauagcuuuagacauaguaaauagcaggaagauuucuuuccccaguagguaacugcuuucucccgagcagcucuuguuuagaguggauaagauaaaauuguguuugucagugaaaaguaacuuuaaaucaaaugucauugauuuugcuuauuuuuuuuuaaaaaagcauuucuaauucccuguuaguguugauggaaaacgacagcaaauacugugcugguuugucaauaaguaagccuuuaaaaacucuuacauacaagugauauagacuugaauguaacugcuuuguguagaauugcuuucuccauagagcucauucauaauuaaaauccugaauaauauuuuuauauaugaaaggaaguaaccaguaauuccuugauuuaaacauggcaauauuucugauuauuucuaugauaauuuuagucaguacuuaaggauuuuguguguguuuguauauagauuugucucuguguguguguguguuucugugagugugauucugaguguguguguggguggggagugugugcaugauuguguguuuuuguacaugcacauacauuuuaacagaaagcuauucuauuugccaaggaaaacaagauaaaacagaguugugcguuuucaaguuuguuguuuugauuuuuguguuggggagauuuucgccucauagauacuugcaaauuuaauaauuagccauaagaagaagggcacuaggauagaauuaaauguauacuuaauuaucagggacguuaaacaggauaguuaguacccuggauucuaagagcucuaaauccugcaauuuagauucucagcuucaguacuaucaauuauuuuacuauuauuauuauuauuauuauuauuauuagcacaauggccaguaccuuacaggggauugauaaucuguucuguuggucaacuggucagucucacaaucuaugcuacaggaaaagcuaccugaaagccccgaauaacacugcuaucuucucuucccuccacggccaugcucaggugcagacccaccuggaaaaccccaccaaguaccacauacagcaagcucagaggcaccagguaaagcaguaccuuucuaccacuuuagcaaauaaacaugccagccaaguccugagcucaccauguccaaaccagccuggcgaccaugccaugccaccagugccggggagcagcgcacccaacagcccuauggcuaugcucacucuuaacuccaacugugaaaaagagguaauucacgucuccucuucuccucuguuucuuacauuccauuaacugucugugggauacuccucucgcccuuagcaauggacugucuuuuguccaccuggucauugucaccaaccucuguccuagaucuacuggugugaccguuuauauuucagccuucggucacgaagacuagguuacuggguuuauugcacacgacaggagaccugacuugcucuaagcagaacguggaggcgaggaugcuuccguaacucccaucaccguccuuagaugaguguuuucuucccuucuaugccuuccaauuugugaagcagcgaacauacagacaggagaaggggaaaguggaaagggaaagcaaaaauagaaaaggcgugcggcggcaggaggcuuaggagcucugcuugcugugaaugucugggauauuauuuuuauguuucauggaguuggagaaagaaaaaacauggagcagguauggguggauuugaaugguauggcauaugaggcuuuuaaagaaagaucaaggcuuauuacagcauccagucggucucaaaaugaauggcugccuggugacacuggucugggcagagggacaaagacuuagucccucuggugacugaaauaacccaaaaguugugugacagucacuugugaacucacauuaacacuuccauacuuaguaggaccuuacuaaaacgagacucgaguucucauaauuugggaauaucagacacugaaucacagcagcaccccuguccaauuuaugcuccaaauuuugauacaaaaacuagcgugaggguuggagucuugucucuaaucuggccucuaccaaagcacauacuucuuauccacccauaucugccauaugcuucacccaugucucccaccauuauugugcuccuugguuagcaucugcuuguuugagaguuccauccaucacauugcuauggcacuaacauccugugaauguguugcugaaaggcguuugcaaauccgagucauggacugucucugcuucuguuucugcaggcauuuuauaaguuugaggagcagagcagggcagagagugagugcccagguaugaacacgcacucucgagcgucgugcaugcagguacugaauggccgggcaggccaaggauguaacacuugauaaugagugagaaucuauauuugugaaugaucgcagcuccugaugacuucaggaccuccuuuccucccauugauacuuuuuugauagaaggaucuaugaacagaccuauuuucuucauaguaacucaugaaugacuagguaacaacuaagaagauuaaauauguguacccuuuaaguuucccacagucauacggagagggaaauauccauagauugucguaaaaaaugcaggaugauuuaguuaaugugcauaaaucuccagcaccuuuuguauagcauuguaccagccuucuaagauauauuuuugaaaccaagcugugccaaucucugcauuguuuucuaaauggaaccuccuguucucuguauuaugaagcuucaguaagcuaauaauagcucacaagcacuuccccaaggaucugaagaucauuauuuaaauucuauuuagcgaauaaauggaagcauuuauuuauguauuuaugugcuuauucagauguaugggauagaauauaauacaaacaacaaaaugguuucuuugccuuuauauauaugcuaaaguauauacuauuuuaaugauacauuaaggacacuaauuuuguuccccuaaaacuaaagucaaaauuuauaaagaaaagugguuuauaugucuccagccuauuuucuuauucaucaacccagucaaaaagccauguauugcaaauaaauaagcugauaugccaggaacgaaaacuaacaugaaguauacuagcucuauucaaaccugaccaccaguuauuuuuuagagaaaucacuugcuaugacucauucuuuagaucagacguuauaguauauuccaauuuucugagcauuuuggaagguuucuccugaaaucucaucuguccccagugagacaauauaugcuauuguccccauugcguagauuggcauacugagauuucugaagacuggaggcguugcccuugauccaggaagagggugaaacuagauuugaacccaaugcgcauaaugcuggagucucaccucuuuaaugggagguacacaugaacacaggggugcccugggcauuuacagaguucacugagaauccguacagcacucuucagacccaggcacaaacacaucagccgggaaggagcacacgguguuuacaaggaaauguuuccgcagacuccaccacugcugcaaugcguguguaaucaccguuguuuaugaugcuaacugguguuuugguacuucagcaauaaaauugaucuagagggaaugucagcuccacagccguaaugauaaccucguccuagugcguuccucugggagcaccagacucacuggcagcuguacaaagagguguuuuccuugcaagugacuacaauccagccaguggucaggggccccacuggaaagcaagggccaugaaccagcuauauuuccuuuuucuagaaggcugugggaaaggaaaagggaagugguagcuuugugcaagaggggcuuccuggcucaucuuuccagugucaaguguucaacagaaucacagcccagcugugcucgugguguggcuuuaagcugcuucucaucacugcaccugaauaguggcuacccugcuaguagcccugcuccccgacuucagggugauaaugcacuggaaggaaacacccaggcucagcucuugcugccuacuaauggcugaaaugcuagcugugaaguggaguuuucaucaccgaguccuguuaguggguuucacuaauauccugauuuuacuuggggagagaauacuuucacuucuuagacucuguugcuuuagguaagaaaggaccaagaacguccuuuaggggguggccuuacaccuguuucucauuguggcucuuuuuaucuacagauggaugauguaauugaugacaucaucagccuggaaucaaguuauaaugaagaaauuuugggcuugauggauccggccuugcaaauggcaaauacgguaccgauggccuuuuuaaaaaauuuuuguuuuccaagaaaaccuugaggucauucucuguucauucucuucuccccacccugcccuccaucccuagaacucaguuuauucacaaggauucuuugaaaaauuuauuaguaaucaaaugggaaaaggaguaaguaguuuugacaucagaaauuaagaagcuugcucgaguuuaucacgagcacuauaauuaagcucugugugcaggagugcaaccucucucucccucucucuuuguguguguguguguguguguguguguguguguguuuguacagguauacacguacacagguguauaugcaaaacugugcccauguauguagaaagcaaauguccaccuuggacggaugucauugcucagaugcugucuggcuuagcaguuuaccuuggauaauguaccguacauuaucacccuggaggagaggggugcuagauaauguaccguacauuaucacccuggaggagaggggugcuagcagggagccacuguccagagggguccuuugguauacagccccuaggaucugccugguucuucucucucagagccaggaucacuaauuuguaccaacggggcugggcuuucauugugggggugggggugggguggggcugggaauuggacucacucaagcuuugugccugcaggagcaagcacuaaaacaaacugagcuaccuccccaggccccuuuugauaaaguguuaaacauuuucacuuuugauaaaaaaaaaguuccacuuuugacaaaauaauucagcucuuuagccaagugacucacugugacuugugcugcucaaagcugugucaguuugaccccaaaccgugaauaagauguguaggcgggguccgauguccccaggugguagggagacauugagauuuccauugcccagcagaagagcaguuaaaguucauaaggcaguccucacggauuuccagcugcuuacagugcucauuugaguuaccucguccucuauaacuugcaggguuuucccauauaguuuauucuauuucaggccuuauauuuguauuuauauuccugucuuaccaaggacuuuaaaaagucccauucgaaguuguuuuuagucacugccuguggugggguggcaccacugcugucugagauaccgcuggguuaggcagucugugggaggcuggguaagcgcagccugcucaguuuguccugagaugagcuguaagcucucauauucuccaauaacugcuguccaagggaguaaccuguauuaaggacaagccauaagggggauaauaaggacaagccauaaugagggaauguuaaagugacuuuugugccugguuguguaucuguguauccauguguguccugguauacacgcagguggcuugugugagcacauggaaaccagaggaugcaguuucaucuucaaggagaaaagugccauuucuaauuguauaugaguauguguaaccagagacuguauauguucaaaaauggugacuuuugaauugugugaguaaacacugcuucaaaaaaaaauugcuaacuucucauaguaaaugcccucagccagaaacagugcagcccccauuuacugaccaacacaaaaauucaguuaacucaguuuuuuuuuuaaauauguaccgacuucuuuuugaucauguccaagcuguuuuugaauuucuguggugucucccaaagucucaagacguccccuuaaagagcuagcaucucuuuccaacccagcuaaacucaguuuguaguuacuuuuguguggugugccugguuguguaucuguguauccauguguguccugguauacacgcagguggcuugugugagcacauggaaaccagaggaugcaguuggaugucucccucaguuucucacggcuuuguuugugaagcaaggguucucacuaagccuagagcucacugauuugguuggauuugcuagccagcuugccuuggagaucucucucagccuccugaacacuugcugcgauuucaggucaagaucgagacucacagguggcuuuuuaugguggugcuggggacaccgauauucacgcuuacgugggaggguuuuauccacccuaccacuucuccaaccccgcacugugauuuucuuuuucuuuugcuauuuuuuuuuggaagaaccacgugaucugggguucugaucaaggugccugugcccugugugccuuggcucccuggaacucuuagcuuucacgcucuuguacucuguccguagccagaauucugggauaaauauaaauaagauacugcaggaaacuuccacuagagaacuuaaaaauagacacagagacuugggcauauuugagguaugaacuagcaacggcauggucaucucaaagagauucugucgaggaaguagguggucuuuuuugucagguugauacaugcauaccugggcacacucaaaaguacugcgaaaugauggauuucacguuaucauugauuuuaaaauaaauuuugcaaugauggggaacuuugaacucaccagacccaaaccaauacucugaccacuaacuuucucuugcauauuguccaaauuaauacaaaacaucagauucccuacuucuuggacaucucaaaaaaaaaggauauacagcaagcaguucacagcaguucuugaaggaagcagugagacauagugguuaggacuugaaauuagaacccauccuggguucagauccaaggugugcacugauucugcagguuugcaugcgaucuacaguaaaguccuguguuuccacaucagaaaagagaaagggcuacuaauuauuucuaacucauuuaucuucuuaccuaacgaagaauaaauagcauuuagcuuugaaaauagaagcugcauucaaccuuacugucuaaauuuuuccuuguacuuuguucguugcaagaucaaauacuuuauuaauagugugcgcuuauucagcugauauucauuaaggcucaacaaugugccaaacucuguguuaggaaagcuuugcuuuauaaccauggugccccucacagugauuuguacauuagcaccaucagucccagcuugcuuccagcugaacugugcuuggccaauccuucugaaggcaauugacaugacuccaccgcuugcuucuauagacuagaaugcacacagugcuucuccaucuacacuggcacugaagucuaguuccugcauuagcuaaucagcccugagaagcuugccccaagguugacagcaucuaucuccaucuauccagggggcuggggucauagcucagugguagggcauuugacuaggaugcauccugggcaagauaaaggagcuguaaagggaaacuuucuauccuggagcucacagccuggagggaccacuguacuaccccgauaguggaacucaguagcugaguguggccauuuccaggggauucccacaaagcaaucucccauaggaaauggugaccucauucccaaccaggagguaguaucuaggagcugccguuagaagucacuggccauauugccauauuugccucccuuccauaucacaggcuagaucaagcaaacugccaccucaaggguuucuuguccugacauaauucugcugauagacaguguuauguagagguuagaagcagacucuagauguuuuguuuguuuguuuguuuguuuguuuauuauuucaugcuggguguagaaccccagaccucaugcaugcuaugcaagugguccuacacuaagcuauaaccccugcccuuaugcaucuacuguugagugagacauuugaccucucugccucaguuuccuugucuauaaaguguuauaucaacugcaguggucuugaugcuagaacuugagaauuucauccacaagaaguggcuugacccuaauaggcuccugucaaagcagaccuccacugggucuuuaucaucuuggaauucaguugucuacuuuaauauccccaccaccaccaccaccaccaccacaguaaaguugaacuugacuguuaaguuuaguuuaggcauuuuuucgccccgcuucuuugauucuuugaaaugcuuuguuucaaguuaacuacuucuucaaaaguggaaaggacguaggaaggaagcuguccuaagggaauugaggucuagagguaacuguuccuagggcacaagggcccucuuguacucucucaaacaaagaagaaaaguccccguuuacuuggguuaacugcgcaauugauauucagacgaagaagggcccuuccacagagaaaaacaaucacauuuuacagugaucacuuccuugggaaaauauuccuuuugguggugagaggcaccagugcgcucaguuaagacuaugacuggggcacaggcagcagcacccucaccucaccuuugccugagcugcccagacuguggcuuucuggaagggaaaucuuguccagagguauaaaugcucugcauagaaaguccagcaaagaugcagaucggccaaguagacaugcaucucuucgucucucaguccaggggguuauucugacccuguuauaacuuaacuguguguauaagaggauuuuucuaacccagaaagagaacuacaaaauuuuguucuuuucuuuuuuccuuucccuuuucuuuugcucuccuccauccccaauuuuauuuucuccuccucugucuucucccuucccucccuuuuuucuuucucuucucucuucccuucucucucuucaaaguauagucugugaugaccuagagauuugcuuugauuuugcuuugggauuuuugagauaggaucucauguaguccccugcuggccuugaacuccugauccuccugccuuagcuucuuaauggcuggaugacagauaugugccacuaugcccaguuuugagugaguuguaccugcacgugcgcgucucucauuugucucuuaaaacaugaacaucguaacagaagugcauguuuauauccaguucacauaugaggacauaagacacacacaguuaauauuucuagagcuacuggauuaaucuuguagcucacuguuuccaaguuuuaauuugcauuuuugguuuauuaaugcucagauuuggaccugggaaauguguuuagacuucaguuccuaauagcuuuguaacuuucaucuuuuuggccuuuuacagugcucuaugcaaacaugcuaaugccucucguggccccuuaaguugaacaagaacaaaaccaaacacacagagagcaagguugaccccugaggugaccuguuucucaauagaaccucucagagcaaugacugcuaauaaucaggcaccaguuaucagagccuuugcuggaaggcauugaaauguggcccaaggacauuuuaaguuagcgcagugcauauucacuggcguguggcagggugugggugugaguauuaugcuuaugaagauucuacaagugcucauuucuccaagaccuacccaccugcccgcccugccugcccugccugccugucaccaccgucuuacuaauauacacaucugagagcagcuuccacuauguacaacaccucccagccccaucucuucauccagggcuuuagcucaugcauauacagaggccagagaccagcaucagaagucucccaccuauuauuuuugagaccuugccaauuaggcuacacuggcuggcugcugguaagcuucagggauucccuguccaacaaccacuucagcccugagguauaaaagauauguacccagauuuuaugugaguugggaauccaaacucauaucauuaugcaugaacagcaagcaguuuauccacugaacuguuuuccgucucuuggaucuaaaacuuaaaauaaccaaaaaguucuacagcccuuaucugucugucugucugucugucugucugucugucugucucucauuuaccuucuuaucucccuaucuacauagugugugcaugaauguauguguguguauuuguaucugugugucuauguguuuguguuuaggugcaugugugcaacagcauacguauggaagucaaaugucaauuuggaagucaauacagggaccccaggaauugaacucagguugucagccuuggcaaaugucuuacccacucugccauuuuguuaaccuccaaaucaaaaacauuuuuagugucaaccugaugcuuuaaguagaguuugauaaccaauugcaugaacuagguuacaguccaaaugcuggugaacuaaaaaaauuaaauacaaaguuaucuuuuggccauauguauguauguauaagauguaaauaaaacauaaauaaauuucauguuuacaucuagguauuauucccaagauaaauauguguauaaacaucacaaaauuauaaagaaguaaaaaaaaaaaaaaaacccuaaguccuucuugucccaagguuuucaaguaaaacuagcuuauccuguauguggaguaccaccuugcuguguaccucugggucccuccaugguuuaauuccucuuugaugcuuucugaaauuacuugucuaauacauaauagagagcuaugaucagguaaaggaaaggcuaaucugcaacguggugugaugcagguaucaaggaaucauuauuugaaauugucuggcaaugcugaggguccaggauggaaggagugaugcauagcuauugauugucuaggaagauuuccaaggcauaagaagaggaacuuguggcuguccucucuagcuagcuuugagaaaauccauguccgacugggacaucauugucaagaaaaaaugaaaaugagguugcugcuuuaaaacagcccaggagaaccggaggagacagcaccacucugaguaguuaaggcuaaguugagcauuucuuuaauccugcuuuaagugcuguaaauauuuuuauuaaagucuuugagcucccucuuguggcucuuuggauaauuucaaucucaaggaagccagcuuuucuuuugccauaaggacaccgcuuuacaaaagggaaguauuugcucauugcuuuucuuuaugaaugaaagcaagggaaaaaaaguagggagaggugaaagauggaggaagagaaacguccucugauggaagccacgcauggacuccuauuucacaggaauaccuggcgcccaggggacauuugccacuuuuggcagcaggugacaccuugccaacauguuuggaaugugcccaccagacagaagucagugcgggcacccuucuuacucccuauauaaacagaucauauaauucugugugaguccucagacuuuccuguuuuaaaaacacaguucuuuauagcaaagaguguuguuuccauaaagccugaaauagaguaugaguuuuauugaaaaaaaacaaaaacaaaaacaaaaaaaccucugcagucagucaacacccauugcuguucuugucugugucuaguuacccgucucuggaaacuugaucgaccucuacagcaaccagggccugccaccgccaggccuuaccaucagcaacuccuguccagccaaccuucccaacauaaaaagggagcucacagguacguaccuagcacaaaugcuucuuacuaugauacucuguucucuuccccacuggggagcguuaccaacggaacagcaacguuuccugugcagcuaguggguguucuuccaguguguucgcuuccugagccucugugcaguaauuuaauauacaguauuaagacguuaaguugccaguuuccaggguugcugggagcccuuuggguugaggguuauaggcaguacacgccccuguaaagugccucuccccuacccgcuguguaucuugcuugcugagccccuggagucuugacuuaggggauccugcuuugaauuuuccaucugaguccacacuugggaucgaguaagaauguauuucuuacaucuuucgaugccuucuccucuuucuccuguauugugugcaugagauuuauuauagaaggagaaauaaaucauaaaauggagccaucagaauguuugcucuugaggcaagugugaaauuaccuauuuugccacuuuguuugaugcuuuagggaaggcauuugaccaauaaaacaugacagaaacuguauuagaaccggcauucuaccauggugaauuuuaugguccuugccccaaaucccuuuuuauuauuuaguucuugccucuugcaaaacuugggggugggguugaguagaugggguacggauuguugcaaagacuguucuguccaaaagcauuacaacaaaaacuauuucagaacauuuuaacauaggaaaaacaggguuuuuuuccagaaaaguguuaauuggggcucaaaagguaauuuacuaauaagcaaaaacuuaaaaaccauuaagaagcaguggacaguaagaccuucuuacccuucuauaugagaaagcaagcgagaaaguggcuuggauugaccaucugaauuugggagauucuaauuuuaauucugucugcacacacacacacacacacacacacacacacacacgugcauaugcaguuaggaguuucaugauuacagguuacauccugggaaauaguucaccugaugauuuugcugugguaugagcuucacaguguggcuuuacguagaccaagaaggcuguaauaucauuaaacggugucaucuuaauuacacuuauuaauuuauauucaguguacagccucucuuugacuauuucaauguagugugagauggguauauacauuuaugauauauaaauauaccauauauaucuugcuuuuagaaaggaaacuagcaugguaugauaagucucaaaaucaauaaacagcacaauuuguuuaauacuuuuauuuguuucucacaugauaaaaaaaaucucuugacacuaaaauauaaugcaacuucucaaauggaauugccaccaaauauaucuagacccuuccuagacaaguuguaaauacacagugacuccuaagaauugugacaugaacacguucuagaagaugcugacagaaccugacuccacauucuggaaaaacaaaacaaaacaaaccaacacuaccaacaacaacaaaaacaacaaaaaaaaaucauucuccugaguuaggcaaaggccauguaaacagauccagaaauauucccugccaguuuccaugucacugcauuacaaaggcauacaauacuggaaaguuauuuguccugaaaauaaaguuugacucuuaauaauagaauaugccaucaagggcuggagaguguuuaagaacacccacacaguggcucucaacuaucuguggcucaagucucugggaucugaugcccucuucuggccaccuugggcauugcacacacauggugcacggacacacagcacauaaaauaagugaaucuuaaaaaugauaugauaucaaauaguuucuauucauuuuauucuuuuuaguacuagcauguagacuugcuguacuguggcuugucaucugguuuguagaaacugagcuuuucagagauuuggcauauguagcauuaaaagaggcagaagucuauagaagguguaauuugaaaagucacauuuucauuagacuccagugaguuaaguuucaaauguucagaagagaugcuuuguaauuuacauuguuaugucccucaaaguuccaguuucuaaugacuucauucacgugcacagcguguauuuuccccacagagucugaagcaagagcauuggcuaaagagaggcagaaaaaggacaaucacaacuugaguaaguuugcuuaauuuauauccauggcauuagacauuaaagucaguguucuucauguaucaaaaaggugauuccagcaauuucacaggaaaguuacuauuucucguuguuaaagguacagugagaguauuccagagagauucuauuucagaucaaacuauauccauaucucugucuauauauauuuuuuuccagaauauacauuuacauauauauguuuucucuguauacauauauauacacauauauguacuuauaugugcagagagagauagagaggagagaguaucuauguguguauguacauauauauauauguauauauauauauauauauauuuaucuguguguguauguguguauguguacauauauauauguguguguguguguguguguauguguguguagagagagagagcuacagagagaggagagacagagagacaaaguuuuauauuuuugaagaacuguuuuuguuugugguaguagguguggugugguaguggugguggagagagagagagagagagagagagagagagagagagagagaagggagucuugaucuugauccccaacuacccaauuauaaguacugcacauuggaacuuauuagcagaaggguauuuggagaucaucuuuuccaaugagauuucaagguuaaaaaaagacaaaagaaaaggagagaagcacagagaagguuguggugggugaaguagccaaaugaugucuaucuguuacucugaggcauuauguaacacuagaaugucuuuucguguggggcuuacucuucacagaaccuugaagcuuuuaccugggaaaacuguaugcuuaagguacacauugacgagagacuacacuguggaaauaaagguugggugcagagguagggagucccauaagggggcuccuuuuaugcuguuucuuacauugaaguuuaagagugagaguccuguauagaaaccuugcucucaauguaugagagagaagagccccucucuguucuauuagccaggagaaagcaucgcuaguuuucagguaggugcuguuuuccugaccuuuccaaagaagcuaggugcacauccuccugcucagguccccacagagccuucgcucagcauugucaguaaucgcagaugggcucggcucucagcuggagagcugugaauacagucuucaagucuuggcuaauuccugggaaguaauucucaggguccuguugaccuugacucagcccugccuuucuaggauuuagcuuguaacaauacuuacuugcugaaaugugcaauacuuaauacuuaauacguucaguuauucuuuccaccacuacaaguuauugagcuccauuuugauacaaggaacuuucuguagaagcaaacuggacaaacggguuuucuacuggugggcauguucagaugucaggugccucauacuaauuaccgagaggaacaaggaggauaacaauagauaucacaccccauuaugaaaggaagcauacuagagggaugauucguggguccacuggccaagaucuagaaaccagcuugucugugacaguugccccaggcauguagaaguugguaauguuaauguuccuuugaccuuuagcuucauacacuuuaggguguuguuuuauacuuuauaaguuuuauaaagucauaucacuuuuauaauaacuguuugaagaggcaaauccuacccaaaagguagcugggucaucucuaaauguugacagcaagagaacccagaggcaugcagggaagugagagaaggcaggugugggauauuuuagcaaagggauucuuguuacacuuaacaugccagcucacaucauugccugggaugcaaaggugacagauaguaggugaacaauacguaugagauucagaguucugugagaagaagagguggagcccagugaacauaguaucaugauaggcauggggcucaugggugaacuugaguugcuacuuacaggaggagagggcuccuuaggggucuggaagaagaguguucuaggcagaggggauagcagaggaagauggccaaugcauaucugccuuggauguaugugggacuaacagcaucagugaauccaucagcagaagagcacagguccauugccagagaagaugcugucacacuggaaggggaguacagggagauaugggcagggcagggcggggccaccagaucuuuguaggacuccucaaggacuuaacuuucccuuggauaaaaugggaagugaugggggcaagguucagguugacgucccucccccuggucaaaugguagagggugcagugggcucgugggacucacaggugccggugaagacuguuaugcuaacccaggcaagggguggcguuccacagcgggaagcaggagaacugcuagaacacagagucaggaaauauuuuaacaacagaagguauuagaugauagaugacggagguggaagaaagaaugguguggcgccaauuucaggguuccagccuagacauuugaaaggaugucgauacuaaugagguaaguuaccauuuagccugagguacagcaaagcuaagcugaaaauugugacaucucgugucuaaaauucccuucaucagcaccacugacuguuaauguaguguuucuauguauguuucuuauauuucuagaacucuaauaauaggaauuagcauuauguauggauauauauuugugugcauauauaauauaaauaaauauauuauauuuaaucauuggaauaauuacucagcuaaggcaaauaguaauuuguauugggaaaauuauguauagcauuaguuaucuacauaugcaaaauauuagggggcaaauauaaauaaaauguuagggcacugaaaguaaauccauuuuauuagaccuuaacuuacuuggaauuuauuuguuagauuagguaaauugagaacauuuacuaucuuacuaggucaccauccccugagagugauaguucugguggguauagaguacagggugaggaccugagagugauaguuuugguggguauagaguacagggugaggaccugagagugauaguuuugguggguauagaguacaggaugaggaccugaaagugauaguuuugguggguauagaguacaggaugaggaccugagagugauaguucugguggguauagaguacagggugaggcugcuugcaggaugugugguauagaugugugcuguccagugugguagcuacuugccauuugaugccuagagcaucugaauuguaguuaguccagauugggcugugcuggucugggagcuggcccgugaaacacuugacuggcaugugcaaagcccuggaauuguucccuagcauugcacacaaaaauaugcucaaguguaaaauauuuugauuuugaaagcuuagugcgaagaaaagaaugugcaccuucuaauuuaauuuuuuuauauucauuaccuguuaaaaugauaauggccuauagaaaauggauuuaauggaauauuaaaguuaacuuaaugucuuuuccuuuacuaguuuagccuggccacuaaggaaucuaaaauuacacauguaauguguauuauuuauuuuugucaguccugggcuagaagaggaguuuuuauauaucucaugagcaaaaccaaauguuuuauuauuuuaagugguuaaaaagaaauccaaacaagagugaugucuuaugaucagaaaaauuauguaaaauucaaauuucagcauccaaaguaagucuguugcuaugcaugagcaggugugugcugcccagguuaugcuaaauuguuguugcuguauuuuuuaauugugucauuacagaucugugcacauuuuaugagcacaaauuuguuuucucuuuaguuaaacaaguacaauacagaugugcccaauuuugaugugcaacugagcacccugcccugguuucagggccguuguagaaugaagugggaaauugccugccuaagagcuucauaaaugaggagacuccaaaggcagcucaucccuucuuaaaaguucauuccccuccaguagcaaaaggaagaugcgcuaagauaagggugaagugggcucaaguuuccauuguccuggcuggugacgucaguacgcacaugccuuuaaugagauaugcugaacaccgggugugccucagucacuaauggcccuuucccaugcucuuuucuugaaguugaacgaagaagaagauuuaacauaaacgaccgcauuaaggagcuagguacucugauccccaagucaaaugauccgugaguacaaucgcauguucaucugcaucaucuacuuccgcaccuuuccauuuucucauaugagaaauuaaaggacucucucuccccucacccccccacccccgcuuccuuuucucagcauuuccucugcuuaauuucacgaaacuaaaauuucaagagaaauguacugaauuguacgagcugagauaguuagcuuugaaugugggcaguagaguuuaugggcaucugagaacucagcagaaaauuuugagcuuggggcuugaggcaggcuuucacggucacacauacaugaucccaauaguuguuaaggcaagauggguggcauguaggaaccccaacuacauagcaucucuaaaugggcauugaugagcagacacugaaaacaucaaguucaaugauacugggaaggcagaaggucaguaguuuuuaugaaaacgugcauagucuuuguauguuuuaccaaucuaggaggagagaaagcaaugguuaauccccuuacaaauuacagcugaucucuguuucaguuuuugguccucucugccuccucucuuggagauaauagcuaacagauaauuuucgagucuuuccuaccacguuaucugccacgucagcaaacuggucaacaaauauacaauuuuuauccauuagaaacuggcccauuugagaugaagagcuggggggauguauauauuuuaauggcccccacaggcauucuaugaaauuagccuuugaauaugaccuuuuagcuaucuaauaaaaaguaaagaugcaaucaggcauuauucauucaaggcuuauuaaauucacgacucacauuauugucggggaauuuguagcaaaauaaaauaaaaccauuaccuaucgugaggugguuuugauaaaugugcagccauuucugucuucuaacacuuuggcuucccaggcuucaaggagaagcguguucaagcuggagacauccagcgucuccauugugccgcacaaauucauccuccuaagggcugugaccuucauuuccuacagucagucuugcaugagagcugaaauugaauucccaaucccucuucuuuaucagccuuuccccccuuuuuuuagcauauucuuuuaaaacuguaguguguaaaucucuucaguaacagauuaugaaauuaaggcgcgcucuaguguaagcuuggauuuacaugucuccuccauuguaauggaaggcuuauguguuuacagagggggcugguagggagaucgcuuggcaggcauugucuuaagauaaaacugcacuguggguuuuccaagccggguauuuggacugugccuuggaacugaaauagagacacacuuuaccugauuagugucccagcuccuucccuagaacgaguguacuucagcauuuacugacuugcccaugcagaaagauuccucuaaauuacccaaaacacaacauuugaaucuaauuuagccaaggaacauaauuaauugagucucaaguagacauauccccagaugccugagagaaguaugucuugaaaaacugaguggccaacagcucggcuugagaagccuggcucuggcuucucccuuugguggccuguacaaggcauggucccuuacagugguguuucuggcuggcugcuacagcuuuuguugcuuucaauuuuuagucuugagaauuggucccagugcucacucugaguaucuugggacaccucccugggcugccguuuuuggugcucagauaugggggauccaccucagggucuucucuggggaggcuguagcuguucuucuccuuggagaauuccuguuuuguuccucagccagccccuaugaggaucagugaccagguggcucauuuaaauggccugcuccucaccuauuccauaugacacuucugaucagcucuuagucgcuguaggugaugggguugacgguucuauuuaccucggagagauuuuuauuuuaucacuauagucaucaucaguacaaauugucuacuaaagggacuggaaagauuacuuccacaaauguaguucacucuccaugguuuguucugggcuacucaaagauuuuuacuguaacuuuguccuuguuugcuuuccacugcugugauaaaaauauugacaaaaaagcaucuugggaaagaggaguuuuacuuggcuuucguauuccaaucauacuccaucacugaaggaacucaaggcagggaccuggaagcaggaaccgaagcagaggaguacagaaaugcugacuuucucuacaaagcuuguucagcguccuaauauuuccaggaccaucuucccagaggugucauagcccauauagucugggccaaccuaccaccaucauuaauuaagaaaacguucccacagaugugucuacaggccgaucagagggaugcauuuucugaauugcuguauccucuucccagaugacccuggcuuauguuagaucagcuuuuguccacaguuagcacacuggugccacaaugaagaagcugaaagucacacuguuggcaaccauugauauuggaaauccagggcaguaucuggccagguuucuaaccauggcaguugccgugauuguguuaaacacuuaaacacaguacuugguccaguauugaaugauauucucaaguucauauaaagcaucuccuuugauuuaauuacucauuuacaaggcugcucaaaagcacauaguaacaucauuucacagaugagaaaauggauacagagugagcuuagauaaugcccauaauaauucaugaugaaaauugaagaggguguuuucacaccuuagacaagugguguguucucacaggccuuugguucuucuuauccuaucccagugacuaagucuuuauaguuccagguauauacaacuguuuaagacaguuuauacauaagguauggucauccacacacauaaauuaaauaauugauuucaccuagugaaaggucuguggucuagaugaaauuguacuguacugguuucaacaucugcacaaugucuccaccuuauguaagguguuugucaggagaaagugaaauguuauauaccaaauaagggaccaguggccaauguggggugagcacuaauugggaucuagccaucacuuauuuguaauugccuuuccaacuauacgucaaauacugaauuuucuuugaacuccuaauuccugaaaggguccauugucuuguuuuaucacagagacaugcgguggaacaagggaaccauucucaaggccucuguggacuacauccggaaguugcaacgggaacagcaacgagcuaaggaccuugaaaaccgacagaagaagcuggagcaugcgaaccggcaccugcugcucagaguacagguauccacccucugccaugugaacugauuucaggacaauaggaagggugauguaguaagcccuaagggagcuggaggcagucuuaauauagguaguccuuucuguuuguuggucccauaauugugaguuugccuacugguaaaacauuauuggugauuccagacuaucaauggcacguuugcaaccacucuuggaugacaugcacccguuaguagaucugaguugcuugcagcucuuugcccagaggcuaagcccaggugaagggcuuuuuguggcagcccucugaauuauagacuguuaaaugacucguucccuuauaguguugucacuuagguuggggacuucucaucuuacccugacccccaagcaucauacgaggcauguagauacuucuuacagccaggaaagucacaacgugcugacugggucuggguaucagagaagccucacccaggcagaaguuaguacuccugguuggguguucagugugaaugaaucuacggugcacucugcuugaggguguauaccgcggucaucgaacacccaucuucccggugcuccugaacacuucacauuccccacaaguuaacaacacauuggcuguggcugcacugauccuuagccacggggccaggaggcagaaagugguccuccucuaggccugggcuuuagaauccaggagguuaaacagggguuagauguaaauuaagcaucuuucuuccccucccccccacauaccuccuucuucuccuuuaaucuguucuuugucuuauguuacuuacaucucuucuauaaaauggccuuagguaucugguacuugguguauccauuuguaagguagcuuauguuauuuccuuauuaaauuauuuaaauauagccaguuuuucuaaggaaaagcuaagucgugucuuauguugagguuccccaucucacauauccauuuuaaauaugaauguuauggaauuugggccuugggaauuccauggcagugcccgcuuggcuuucuucuguugacugcaaggcuggcucuaccacuuuuguauguuauagggaaaaaaaucauuaauuaggcaguagagcucuacagugccacaaggccucagagcucucuacgagauuuaaaagcucauuuagaaacugaaggaacuauuuuaauuuguugauaaacacuucuaguuagacaacagagggguacaguaagauguuugugucuccccuaguuaauguauuuucuugcuucuuuugaaaagacaaacuauacugcuacucuucguguugcuguggaguuaccagaaccugugauuuucagccaaggcccggggccuuuccuucauuucagucucaguggugcaugcagaaaucuucauggaagagagaacaggaggccuuauuaucaggggaaugguuuuauuaaguggcccagggcuucagcgugaugccuggggaggcuuauuucuggagcuggucugaaggagcaggcauacaucuggcaucgcaugcucuggguuucugacucauacugcucccaaaguaagggcucacagaugcagccauuggagcacagaccggcuaugguuuuccucacacuugccagccagguugagaggccaugucaugugcaaagugcuuuuucuauccaaaggauauacuuccugucuguauuuuauuuucauauguuguuuuaucacaaacauuggcaggcauuaacauacagaaggagaacugggguauccauagggaaucccugauguccgcuuuaggaauauggggauucaucagaagucaggguugggggaggggaugacaugguucuaaggcaccuugaaaugaggagaucugagaagucacagacuuacaggguaugucagucagcuaauaccacugugacagaaggccacugagcggcugagauuagauagcagagauuggcuuucucacuggcuugguggcugucagucuaagaucagcccugucaucaggauuggcuucuucuuaacccucauccugucuucaaagacucuguaugccguucuacucccagcugagguccauggacuugggagcacagugcagccaguagugagagagugcaccugcuaagcaaguauucaugguauagaugagaacuuccuugccgaauuaaaagauaauaaucucccuuugccagggagaggugagucacauuuccuggaacucugguuguacauucagaaccuggagagcguuugcuucccccccccccuaaacuuuacuuccugucaccauugaugucuuagccacuuccucaucccauccagaagcccgaggaaaugccuacuguuuuggucacacccaaacagaauauugaauauuuaugcccuaacagcuuacuaauggguguucgacuuuuaggacuccaacccgguuuauagaaaccuuggcauuagauuagauaagccgcccuuaccuccaguuccaugccaaugcucaggaggcccuugucacuacagucccuccagaaacccauuuuacaguacuaugaggcaaccaaaaaguaugcauuguacaaagucacugugaacguggagacuggaaaguguguagcacacuugcccugaaacgggggacugaaaacuguguaacacagucucacugaaaauggggaucaaaauguguguagcacacucauucuaaaucaggggaccgucuggcacuugguagcuguugagaaaccaucaccauuucccuugaaaucuuaaaauaucucccaaacauauuacacauugcucagcauuauauuucuguuagcucccauuuuguauuuuuuauuagcauacgugccuuguacaaaaauaugggcuuccccgugacauuuucaugcucacguaucuaccaucccccacuacugucuugucccacccaguuuccuuccguuggcccucuuuauccuucccuguagaguccccucuacugucaugucuuaugcauacauacaggcuuuaaagaguccacauaugagagagaacaguauuugccauggucgggcuuauucuauuucacucagugaccuccaguugcauuuauuucccugcaaacaauuucaggguuucuuugacccugaauacagcucuuuuguguaggcaucucauaguuucccuaucagcucaucuguugauagggagcaucuagguugacugcacccuggccauugugaucagcgaaggcacagagacguggacaugcaagcaucucuauguucgcuaagcccuucaagaaacuacccagggguagaauggggggagccaugggguaauuuuguuucuggucuuuugaagaagccccacacuggcugucaguggugucuguaccaguucacauuuccucaccaguguggugagggucccugucuccucacagcaagcaccuuugccagcauuugcuguaggugguuuuuguuuuguuuuguuuuuugauguuggccagucugacuugagugcuuauccuugucuuaauccuuaauaucuguaagacuguuucuauuuguaauucauaauaaaaauauauaccaucuaaaaggauauuuccuauacuccuaauaccaccugucuuugggaaaugcagaauuuauuuuugaaaaguagcaagcuuugcuuugacaguuuauaguuguccccaggucugaugucuuaaaaauagaaaauagacuucagucuuuaaaagcagucucagguucacaguacaguagaauauaagcgcuagagagcuccacaugucacuacaugucauccaacaugcagucccccggaucaucaaaauggacaccucaguggccccuuuguuagaacugguuucuccuuguccuccaaaaccuuagguagagacacuaauggggauauauauuccaugcauuuggguaaccgcaccuaacacugcuugcacaguuucuuccuuaacugucugacucugacuuuaucguaggagcuggagaugcaggcuagagcgcauggacuuucccuuaucccauccaccggucucugcucgccugaucuggugaaucggaucaucaagcaagaaccaguucuugagaacugcagccaggaacuuguacagcaccaggcagaccugacauguacgacaacucuggaucucacggacgguaccaucaccuuuaccaacaaccucggcaccaugccggagagcagcccggccuacagcauccccaggaagaugggcuccaacuuggaagacauccugauggacgaugcccucucaccuguuggagucaccgacccacugcugucaucagugucgccaggagcuucaaaaacaagcagccggaggagcaguaugagcgcagaagaaacggagcaugcguguuagcgagccugccuugcucugccucugcacggaccgcucccucucuucuucaggagacuuuauaauuuaccugaagagguuuucuugauaauuuuccuuuaauaugaaauuuucgugcuuuaucaguagcccaggauauauuuuauuuuuagaauuuugugagccagacuuguauauucuauuuuacaacuacaaaggccuccuaaguauuguaccuucagcgugcaguaucugugaacugauuucuccaagugugagcuuucugagcaaggggauuuuuuugcuucagagaaguaagugucuguccguuuucauucaggggaaaacuuggugugagcuuugucugucugugaccuccuuugaaauuaacauguaaaguuuaauuacacgaauguaaagcaaccaaaagaagaaaacaaagaagaugaugauuaugauagaagaaggagaagaggaggaagaggaagaggaggaggaagaggaggaagaaagauggugggaaagacauccaagacuuucucgcuuucuaaaugcggcaauuuccugguacugccuuaaagacacagugcccucccuuccuuccagcguuucuaugucuuuguacugaaaacugcguaaagaagaauauauuacauacagacaaaucuagcagucauuuucaugaggauugucuggcuagaaaauguaacuuaugcuaacccaaacugaaagaaguuauuagaccaaggcaugaaacauaggaucugaccugcuggcuuuuauugggcacaguuauaguuuuccucauaagugugauuaaauuuuucauaagguuuuuuugaaauggaaaugaauguccucucugaggacaccggauguuuguuucacuuuuuuuucuuuuuuuuuuuuucuuuuuccauuuuugcuuuugauaaagacaacugaacugggcacauuucuaauuggcuuuacuauuuuuauuuuuaaauuauguuuuagccauuuuaauuguauagauucuuuauuaucaucauuuuuuucaguguuuguauuaauuuguaagaauaugcaucuuaaaacagugaguuuucaauacuuuuacaacucauugguguucucugcauucuuuguacacccaagaaagacuacuuuuaugcaaggucuuguguucaaagagagcuuugcaaauauuuuguauauuccacuaucacuugaaacuguuuuucaacacauuuaagguguaguauuaauagguuaacaaccaggcuuucuagaaaaaaauacuuacauauguauuucuaggguauuaaaauaacuauauucuugaagauugauagccauagcauuuaccaugcccaugauggucaauucaauuaggauuuauuucaacacaccggcuagauucuuuuuaaaaagagaaacacuguauuggcagauuacuugauaacaacauuuugaccaaguggcaacauuguaaaguuagugucugugcauugcuuacuugcauaacccuaugcaauaucuguagaguuacauguaucaagucuagauguuuugugcaggugauacauacugguacaagccaggcugccuaauggaauuucucaguagcagccuacgauugaauccuguguggcauaaagcauacccuuucagaaugaagugccuuaaaaaucucagcagucucuuuuggaccagcacugacugaacuguaacuaggagaaaguuucaagauggaaucuggagugaagaaggaagacguagcguggugccucuguagacauucuaagagcuuccaauuucccuucagauauuuuuaauaugaaauauauuuuacugacagugccaaauucuuucaucaggaaaccuuucucaggaggguuuuuuuuuuuuaaaguguuuaaaugucaaaugugaauuggugaugggugauggagagauccaagagcagugauugucagauguaugaauggauggccuuggugagauucgucaagugcgcgguucccaugcauguuggguaaugcaaaucuuuggaaacacugaugaugcuauccagucuuguagcuuuauuacuuaaggggguagggaaaauaaguucccauucuuucaacucccuuaagugugugacucuuuuccuagaauagaaaugcaaaugugcaugaaaagauaauuguaccauaguguucaccgauacaaucauagcauugucuguuuuucucuucauauuuauguggggggggggugcggggagggcuggaugcagaaguugaagauugcaaugcuaugaugcuagguuuucuuagcugauucugacauuuucuuuuuuuccuuuuuuaauaauugaacaagguuucacaaaguugacuauggccaaggcagagcaacuuucuaggaagcuuuguugaaagaaaguauggcauauugcaccauuaccuuggcuuguagccucugagcuugccaccaugggcuuuccaggcaccuuccuccuaagacacagcugcugggagaggcaggcaagcaauuuagaggugacaacauagggaaugguuuuauuuauuucuuuugugccagccagaauguggauucuuucagggacugguuaagccaagacgcaguguuuuugcucacuguuuuuaaggagagaaugaaugauccuugccucucacuccccaaccccugggugcagaauuguaucucaggguuggaccuccguuuagagugcucaaaauaccaaaauuauccaccugccucuggguaagguaacggaaauaccaaaccuucugacuuugccaaaaacugugcaagcaaucuggucauacccagagcaugaugcaguucaguuugguuguuuguaaacaauaaagcaauaagaauaaacaaaaugcacaggacauuaaaagauauaaacaaagcacaaaggaauguaacuuguuaauauuucugaaaaaaaaugcacuggggagaaguugauguugauaauaguauaaaaauuacccaacuucuugacaaagacaacaaaugacugucucuugcagacacuugcuacuguaaugucaauaacagccccccgcuguuggguacagcaauacuuucuguaugguccgcagcacuguauauuaugauugauauuaauguauccaaugaaauaauugaacuguuguucuucauagccucauuaaagcauuugguuuuucacauuguguu

SEQ ID NO: 12117 - RNA, 58064 nt, Mus musculus
gcggacugccgagcccaggagcucgcgcagaggcagugagcccggcggcgccgcaggucguggagacgagugucgagcgcagggcuagcucgcccgggauagccugagagcgucuucuucgcgggugcuggugccgccaucuuggauggcgggaguuagagccgagcggacuugaggcgggaaggcuucucuguuguucuccgcaggcccucggacgggccagcuggccgagcuuuggggcgcgugcccugaggcgcggggcgcuagugcagcgaugcggggccuccccggggccccgucccccgggcuggggacacgccgaaugugaccgcaaccaacgcguucucucaaccaccgcugccgcugcacgacgggacccggcacugcccggcucccucagguaggccacagggcugacggugcgaccguggggcgcagggucggccaggccgcugucauccugguggcgggccgggcgcgggccgggugucauggccggcgagccaguuuccacaccccugcucagauuucccaguguuucucggaaacgugccagcgccacuccggugcccagcgagcauuccucauauuuuggcaaugggggaaaaaaaauccucccagagcugcccagugacuguguugucacugggaugggcucguucuuuuuucucucgggcugcagaaguggggggagcccggccuugcaccuccucucgggcugcuucgcuuaagugacacccuuuuagggaagacaagaggaaucggggaaggcagcgagagaaaccggucagggucccgccucaaaggcuugcgaccucgccuggggcuuccaaauggguggcccgggaugcucgcgaucgggagccaggcugccuuuugugugaagcgacaaccucccaggcuuuugcagagccggugcauggaugcagaguugggacacaaacgaggugaccguguucauucauuguucucucuccagggcccagggugugccucugguuuucauucuuuguuaggagggacagucgaaucucuucuuucccgguugagacguaacuggguccuggggaaugggccaggucuguguauagaaguggggaaugaauucagggcacgucugaaugccugcaaugcguccuguggggucguuggagacucagcuccuggggcgugaaaacaaccggaggugauaaggcuuguuuucccaaguguucuugggauuuagaacaguuaggugcagagucgagaagcccugagguuccuugcuugcuucugcgcggaguuugaaggacuguuccgccaggugaggcagaggggaggacauugucggcggagggaacagcuggcaccaaggcucagaggcauagccugcgggaguugggaugauuugggggagcagcuaguaaauguggggugcaggaagacagacgucaggguucaaaaggaaaaauugaucgcuugugaagggucugugugauggauaguaaugaacuaguucauuuauuaauuaacuucauguugugaauguuuaguucuugcugguuacugcuuugcuccccucccgcuaugguagugaacaaaauuuaccuuguuaagucuugcuaaccaguuuugguaauugauagaaaauguuuugugcuugcuugaucacugguuccuauuuggagauacucuugcagcuauuucuaagguuaacacauuccccaaacagacagaaauuggcagauuauagaaagcaccugaagaaguguagcaugaaaguauuuuuaauuaacccuauuuauguaguagacucuuuucuuuggacagaguccccagguugcagcuuuguuaagacgucugcagcccugugaacauucuucuucuaaaauagcuccuucgauuaaggcuuaugcugaaguggcuauuuggaagugaagacaucaggagcaguguccaaaucuuuggugcugugaaccacugaaaaccacugagguucuuuugguuugguuuuacucuuaucacuucaagggcuaaguaagcuguuuaaaauccagcagcaacauuugaccuagccgagacuggagacuuggaaaaauaaaccugcugauguuucuguucugaaggcuuaucuucaggucugcaaggcugugauugugcccucaagugcgaucaggcagcuuggugaaggucuuguccauaguugaaaagaccuugugugccugugaaguagagggcuugacugaagggcauuugaaugcauuuuaagggauuuggcccaguaguaaaaagacugagaaccuuuuacuuauuuaugacaaaaaguauccaaagauuaacaaugaccugcaucacaacugcucggaacccagcugcuuuuggcuucaagucaauuaugcucugaugauuaagcuacaugacaguuuuggaaguuaauuugauauuugcagaaggacuaaauauuuuuaauggaaauacaaugacuaacuucaaauugcucuuuuaggaagucuauuaaugaauguuugauuauuuaauguuaaaauucagacagaagguuguuacucaccugcuaccuaaaaacaugaaagaaugcuuugguuugccuguuagguuuacuaguaaugagccugaucuugggaggagcuuguuaacuaaacagcaugccuuaauguugacuugcagaucagaauuuaaauauugucucugccagacagugaacaaauguaccagugaggggcuuuaugaaaccuuaaaagucaagcuucaacuuaaaauuuuguuguguuauuuuucuaaaguuguaaguagaccauaaaaaaucagaaauguuuuuuuuuuuccuuucuugauuuuuuuuuuccuggaucucacuguguaguccuuggaugaccuagaacucacuacguagaccagguuauccuugaacucauagagaucccccugccucugccucccaacuguugggauuaaaaguguagauucuuuaggagguuguugaguuuuuguuuuguuuguuuguuuguuuuuauauguguacacauggaugggugaacuugcuaauuguucauccaguggguucaaaauauacuaauauaacuaaauauuuauguuaagauuccucuguuaugggguaggucuaaacccuugucugcaauccuaggauaguaaugucagauuguuuuauuuugaccuucaaaguugugaguaaaaagucuuuaguuagucauuaaaauugacacuuaaguuuuguagugucugagucauucuguuacuucuuugcucccaggauuauuuguauagcucuuagugauuuuaguuuuuaaaauuuuaauuauccauguauggguauuuugccugcacauaugucugagaaccacaccugugccuauugccuuggagguuagaagcgggcaucaucuggagcugaggucacagacaguugugagcuagcuuggggguggguccuggaaacugaacccaggucuuuuaauugcugagccaucucucuagucccuuagugguuuuuguuguggugauuguuuucauuuuauuuuauguuauuuauuuauguauuuauuuuacuuuuauuguacauguguguauguuugugugucugaguguauaugcaccaaugucugcaguguuaguggaggucggaagagggcaucagauccucuagaguuggaauuacagguggcugugagcuguguggguucuggaaacugaaccagauuuucugcaagagcauuaaguacucuaauugaugggccauuguuccaguccaacuguuguuuuuaaguacauagucucagggcuggagaggugguucaguagguaagaggacuuguugguuuugcagagaaccugggugugggugacuaagcacccacauggggguuuacaacugucuguauauaacuccaguuccuaaagaucuggcacccucuucuguccucaugggacacaaggaaucacaugauacauagacauauaugcaggccaaacacccauauacauaaaauaaaaaaaugcaugcuuuauuaaauauauauauguagacaaggcuagccucaaauuugugaugcuucuguuucaguuauccugagauuugggauuacaggugugugcuacaacacuuagugauuguagacgcucgaguucugaaauuguacugagaaucucaguuuaacugaaggaaauuucaaguggaugguauuucuuuguuauuuauuuagcuuggugcaggcuauuugaauuuucuuuuuuuaauugcucaguguguuaauuggcauuucauuucagucaguguacauaguauauuuugaaaaacacuugacacaguucacaguuuuauuuuuagaccagguucuaaaggauuuaguuggguguugaugaagaauucuaaaagagcuauuuuagaauuugcaaacccuugcgauuuagcuguauuuacauuuuugguuaaagaauggaaaacagccggcaaugagaguuuuuuuuuuuuuuuuuuuucucgagacaggguuucucuguauagcccuggcuguccuggaacucacucuguagaccaggcuggccucgaacucagaaguccgccugccucugccucccgagugcugggacuaaaggugugcaccaccacccccggcucaaugagaguuuuaaguaaacucuuguauggcacauuccuucagugaagugguguggucuguguuguguagaauuacuguccucugucugucugucucugucugagacaggguuccuuugugguccuggcuguccuagaacuuucauacaauguagacgaggcugaccugagcacacagagauucaucugcuucugccucccgagugcugggauuaaaggugugggcaaccaugccuugcuucuugcccugcuucaucuuccuuugucuaacuauuguuucuaauuuauugucauccagcagcaagaguaaucacacugacugcuugaaucaaguucuccccucuuuauuuccuuccauccuauuaugaaguaaaaguucucucugauuuuuuccuugacucuguaaugagacaugauguuugggcaaaacaucucccuuuucuguuuuuauggauacaguccuggggauuaaaccuagggcuuuaaguggaccaggcagacauugccauuaacaccgccagccuguuugccuuucuucagcccagcacaucaauguagaagaaucagagugggcugggauugugugcucaucucccuccuccaugcugggauuuggucuggugugcuuugcaaagguuuuguacauauugucccaauugcugagaguugauauaugcagcugcucuguuguguccagagguguuuccuuguagucaccacugccucuggcacuuagauguucuccugccuucuguuccucaguggauccugaaucuuuugagauguagugugucuuuucccuucaaggcugaacaugcugcagucucuuauuuucugccucuuggccaguugugggcacagcacaguuaucuacugcaaauagaagcuucccagaugaagguagagagauacacugcacuauguaucucuauguaacaagaagucuuuuaaagagucaguuuaauacugugcucuuuuagcagccuaauaguaguaaauuuuccccuagggccuaugaccuauguagucauaggguuuuuagcauaauaauguuaccagguauuggguucuuacuguggagugggacuuaaaauccaaucagaaaugauugguugcucacaugcuguuugugccaccauuguaccaguggguauguccugccaggcuagucauuauuguagcuugcuuuucuccuuuagcacugugcauagcacucuccagcccuuugaaagcuagccaauaaaggugaaucuuccagguccauaccagcuuaauuucaccauguccuaugacucaaggauguggugucuucagcaauggaggauauccaagaacagugacaauauccuguaaugcugggagggugguguccgugagaccucacuaaaguaguaagccauuucuggcaugggucuuuuuauuaguaagcuucugaugucuacuacuuguaacucagcuccagggggggugcuucugcgcucacaugcauguaccccucccaugcauguacauaacauuuuaacguguguguguguguguguguguguguguguguguguguguguguuuagauauagauauuuuccaugugucuuuuuugaaaggucuuucucaugcucccuccuguacccuacuuucuguucccaccccaguuuaacccuuccuguuccaguauucuccuuuaaaucuuuuuuuuuuuuuuugguuuuucgagacaggguuucucuguauagcucuggcuguccuggaccucacuuuguagaccaggcuggccucgaacucagaaauccgccugccucugccucccgagugcugggauuaaaggcgugcgccaccacgcccggcuccuuuaaaucuugauuccuuuauguaguuggucuugaacuugcuaugcuuccaagaauggccuugaacuugugauuuuccugccucuacuucucaguugcugggauuauagacuugaguccucacauccaauuuaugugaugcuaaguaucaaacccaggaccuccugccccagauuuaaaagugauuucuaauuuauuuacuuuacauauaugaauguucuaccugcaugcauguaugugcauccugcauuugucuguuggauucccuggaacuagaauuauggauggaugaugcauacucauaaucacccagccaugugggugcugcuggcaauugagucuggggccucuguaagagcaagaaauggagccaucucuucagcuacuaaauuucuaaauuuuugagauaggguuucauguagucuacacuggcuuugaauucauuauauagccaacucuagccuugaucuaauccuguuucagucucccauaugcuaggauuacagguguuuguuauagccuacgaaaaauuauuaagauuaugugcaugcaugugccuguugggguacaugcaugugaguguagaagccuaagguauacgagaggcacuagaucucccuggagcugaguuacaaguagauguuggucacccgacacagaugcugagacugacucaggucuucugcaagaauaguaaauacucuuaauuacuuacccaucuaucuguccagcgcacgaaugaaggucagaggaagcagucuauucuuucccucuaugcaaguccugggaauugaaucgagaucaucagguaagcauuuaaccacugaaccacuugccagccuuaaaagcgguuuuuaaaaguacuaguagagggggcuggugagauggcucaguggguaagagcacccgacugcucuucugaagguccggaguucaaaucccagcaaccacaugguggcucacaaccaucuguaacaagaucugacucccucuucuggagugucugaagacagcuacaguguacuuacauauaauaaauaaguaaaucuuuaaaaaaaaauacuaguagaugcaagcacucuuugugaaugguacaggguaaugagugcaaguuguuacugugaaggauuuugucugauagaggagcuucgccaagcuuacugcuuguuguucuugcuccucggagagucacucccugaccuuuugcuuuauggccuuuauuguacaguuauuugugagcuccuaucuagguagauaauaaacuccaaugauugauuucuucuuuaugcuuauuuauugauauuuguggggaaauuucauuggagagguugagggaccaggcuguuugagaaugaauugaaaucccaacacuacuuguuuuauacuucucucugucugucugucuaucugucucugugugcagacauguguacauggucagaggacaguuugcaggaguauauuuuccuaccaaguggguccucaagaucaaacugagguuaucagacacuguggcaagugucauugucugcuaagccaucuuacugguccuauucuaugcuggguaaucacaggcuggcccugaguccauauucaucuuucugcuuuagucuccugagugcugggauuccagguauuguguuaucauguccaccaacacuaagcuuauguguggauuuuuugagcagagaucuuuuguaguugacguuguccuguagcucuagcugaggaugaccuugaacucccaaacguuugccuucaucucgggagugcugagauuccccauguucuccaucaucguucuguugauucuguacugagugaugaggaagaauaucaugugguggaggcuacuugccucacgguaaacaggaagcagaaacaggggcccugggacaagcuagagccccuaagaacaugcccuuggugaccuacucccuaaaauuuucagaauuucccaagagcaccccacuagcugugaacuaaaccuuacuguaagagccuuucagcagagauggaagcauacuucauauccaaaccauuacagcugcuuccauuuuccuuuaaauugauauaaaguucuggcuaaguggugugggcuggcuucaaacucucauuuuugagcucuuguuccucuugccucaacuuucuaaguucuaggguuacagguguaaugugauagcauuugcaugagaaacaauuuuuuaaaaaucauuauuguauagggcaacuuuuaggagucaguuuucuuauuuuaugauguuagaccuggggauugaacuuggguagucaggcuuggcagcaaguuccuuuaccuguggaucugucuugcugguaugagaacgguuacuuuuucauucauucacuuauuuauuuagaaauaggaucucacuguguaucccuugcuggcucaaaucuugcaguuuagaacagacugucuuugaacucagagauccaccugccuuugccuccugagugcugggacuaaaggugugcauuaccauucugcaaaagacuaguuuuuaaaacuacuuguuguguauguaagguuugccacaaaaaugucugauuuuaaugugaaaugaagucauuaguguuucugucuggugagccugagugagauaacauuggcuuuugcugcuccuguucuccucagacugucacuuuagcuucuuauugugggcaucagacuuugcacauuguauauuuagguauuugugcuaauguucgacuuuguaauuuguucauuuaaaaauuauuagcuacuaccuaaaugaagaaguaguuacugauuuggagaugaaaagaaaagcugaguuuaaaaacaguucaaagccacaguuuuggcuguaccguugacaaucacucugagcagucagacucugagauagaaggaccacaaaagugcaagaccagccuaaucuacacagugaaacucaagaucagucaacuaaccagccagccagccagccacuggcuauccaaaacaguucaaaagauuuaaagaggauaaugaaaaaacucauuuuguggugagguaaaaaugaaauuggucccaggcaccuuucacuguggacugauuguuucugaacuaccucauacucaguuugcauuuuagaaucaguuacacuucaaaacaacaaaaucugcuucucauacuuggguaucgaaucuucgcuugcuaacauuuagaaggguagacugguccauuucuuuauguaagccugugucggccagucaucugaugaagucaccaguuuguggccagaaauugagaaagaguugaugaggaaacucaaaauauugacacauccugaccagcuugcagugcaugagacugcccuuuuggacugguugagaaaugguagcauaagccuugugcaaacgagaccauugcuguuuucuagcugggaugagaugagaaucagaacagcucauguuugcucagcagaaacuuugugaggccccuccccccagaauguaugcucaauugcagugguaucuucaaacugauuacuagaguuuuggcuucguagguguacauguccagaacauuuuauuuuuuuaaaugugauuuuauuuaguuaggcuccuuuaaaaacuguuuuuauaauuguguucauguggguucaggugccugcauaucucucucucucugucgcucucucucugucucugugaaaucacucuguagaccaggcuggccuugaaauaagaggucugucuaccucugccuccugaguccugggauuaaaggcguguucaccacuguuccgcaguguuuguuauuuuaaaauuaugugucucuguguagguuguuagugcaggugcuggugggugccuugaggacauuugaucuucuggagcuggaguuacaagugguggugagcuaccuaccuaacaggggugcucgggcuaagcucuaguccuuugcaagagcagcagcaaaugaucuuaaccacugaaccagcucuucaguucccagagccuuuuaaaaauuuugagaagcggagagauggcucaacaguuaaagaacauuaaccaaccuuccauaggaugagguuugacucccagcucccacccggugucucacaaccaugggaauccagacauacauucagccaaaacaccauacacuuaaaaauaauuaagaaaagaauuuggagauaaucugcaaacaagaauggacaugaugauguauaauugauacagaggagauucagaauucuccagguaaugugagcagaugguuuauaggcucacaguuggucagcccuuauuucagaaccuggagcucuuuuggaauagguaacauuguuagguagcuaacucaggaaaucuacucaggaguaguuucugaucaauagagccaucacugcuucuauaacaaagaacaacggcauaucauuugguagcuuaugcuaauaguuugcuuucucuguaaucuuaaaagacuaagaaacaugucaggcugcguagauauucauacuguaaucccagcagugaauaugaaggaaggaggguugguauuucaaggccgaccugggcuagacaaucaggcccuguguuaacagagcaagggcuggggauauagcucuguaguagagcacucacccugagcuuuauuuuccagcuccuggguuguggggcacagcauggugacacuagacauguacaugucaaguagaagagaaagcaacacagguauccugccagaaguucacuuagcucuuauuaccuuauuuugucuucugcuuucaagucaacuagaaacuggccacagcauguaacauuguagcacaauuguaacuuuaggacggugcccaguuuuuccaacaaguaggaauuucuuugucuugacuaaucuuuagaacuagucaugguuuguaguugagcagucuugugauuacauggggauuuauuuuacccaaccuacauuuauuaccaccuaugaggaaauuuuuucuguaauaaagauaaaaaagaaugauaacacaaaguuuucauguaugcauguacacaaugacuuaauagacauuuuaaucucuacaauauauuugcagauuguuagcugcauaaauagaaguucauaauuuuaauguaucuucuuucauuuaauggcuaagaagaaggaagggccaaauuggaaagcuugggaggaugacugcuaagagaacuacagauugcuaaugacgugucagcuauagucuguauuuucuguucugucacacguccuauaaauuacuccaaaguaguagaauacuagcaucauuacauaauaauuaccucaaguccagauguauauaaaauuuauaucauuuaagucaauacuacaguagaucaguaauguaaagccugaggacccgauuauuauuuuucauauauccguugugcauaguccugggucucaccaauuuguuuguuuaacucuuaaguuguucccuguuuuuuuaaagcuugacuuuuucuuuguauucuuuuucagguguagguaauuaaacuucaggccuuaucugugcuaggcaagauuuugaccauggaguuauuuccuagccccaaauuuuacuuuuucuucgucuaaagaagagauaagaaaaauacuugcuugauggugguggugguggugacgaugacuugaagcaggucucacuauguaguuaugucugcucuguaacuuaucaucguagaccagucugguccugaaucagggccacaugucaccaugcuuggcccugacuugauuaauucuaacaguacugugagacaauggagagaacuaaauaaacugucuucuacaguucugaguuucucuuuauugaugaagacuuucuacagucaauacuaaccacauaguauauuguuauauuuucagaaacuagagguuuuuuguuguuguuguuuuguuucccaagacaggguuugcccuaguuguccugaaacucgauuuguagaggcuguccucaauagagagaucuaugugggugcuggaauucaaggcuuacuaguuuuuuuuuuauaaaugcagaugaaauuuuauguauguauuuauuuauguaugugaguacacugcagcuguuuucagacacgccagaagagggcaucggaucccacuacagaugguugugaccaccaugugguugcugggauuugaacucaggaucucuggaagagcagucagugcucuuaacugcugagccaucucuccagccccagcuugcuauuuuuuaacuguagugauuagaccuggggcuaugugcgugggacauaagcguuugucacuuaccaccgagcucuaugauuuuaaaucgucuuacaucucccaggucagggacuggaauguuggcccagcaguucagagcacucacuguucuuacagaggaucuggguuugguucccagccucuacaugauagcaugcacugucuucaaguucaguuacaggagauaugguaccuuuuagccucugcagacacugcacacagaugguacacauacauacaugcaggugaaacacuuguauacauaaaauaaaauuauuuagaaguuuuucaggcuggcggugguggugcacucccagcacuugggaggcagaggcaggcagauuucugaguucgaggccagccuggucuacaaagugaguuccaggacagccagggcuacacagagaaacccugucucgaaaaaacaaaaaagaaguuuuucaggucagccuugaacuuacucuguuguccaaauagaccuuacacuugagacucuucugccuuuccuccuccucuucucuuuuucccuugugcuagggauugaaguggcuugggcaagugcuguagcuuugugucaucuuaguuugcuuucuuuuuauaaaauggauguuauuuauguauuuugugugugcgugcaugaaugcuguaguauguauagguaggucagaggacaacuuucaggagucauuuccaccaaguggaugcuggagauggaauucagguugucagguugguggcagccacuuuuaccaguugagccaucucaccagccuuguuucuuuguauuaaaaacuuauuuauuuuucauucauuugagugcgaguaccuuuguuacuguauaauacauacaugugaucagaagaaaaaguguagaaccuccuagagcuauaggugccuguaaguggccagaugugggugcuaggaauugcacuuggguccuuuggaagaguaguaacucgcaauugcugagcuagcucuccccccccacccccaauuuuauuuuuaagaugugaucucauaguauagcucaagcuggcauagaacuuacuauguagaacccaccccuuucaguuucauacuuuuaaaugaaagaauauuugaagaaaaacuccagaccuuagucucauguaugcaggcauaacuagaacuucaugucuagcugaguaugacuuugagccuucuucuggagugcuggccucuccacuccuggugcuaagacuuagguagguuucuuagugugaauguaauaacucauuugcugaagcauuuuuggagaaaguuuaaaaaugggcuuguauauacaguauuuagugcuuguagauguguccuuacuugggaaggacaauuaauaagauuuggcugguuuacuuaagcagagucaaggaauagugcagaacaaaucugacgucgagcuuuucaguugcuucuaaaucccuacccccuuucuuuuuugacagacugcccugccugggcugggacucuguagccuccaacucacagagauccgccugcuucugcuucugcuucuuuuguuuuguuuuguuuuguuuuguuuuguuucuuuuugagacaggguuucucuguguagcccuggcuguccuggaacucacuuuguagaccaggcuggccucgaacucagaaauccgccugccccugccucugccuccugacugcugggauuaaaggcuuacaccaccacgcccggcucugcuucugcuucuugauugcuggguuuagagguauguacacuaggccugccuuggacucuuuucagcagaaaaauuuaaacuuuugguucuuauagauuuaauucuggaaaagccucuggaauuagugagggucauuagcauuaguuauuuuuacuacaaugaaaaggaauuugcuuugacuuuuuaggagaggaccuauucaaaagcacccauaagaaaggcugugcgugcuucagggaggcucuucucugcagguaguguagaauagccuugcuggacugaaagaaggcauucuuucagucucuaauaugagccauguaccuuaagaugucaggacuugccuggcagugguggcacacuccuuuaaucccagcacuugggaggcagaggcaggcggauuucugaguucuaggccagcuuggucuacagagugaguuccaggauagccagggcuacacagagaaacccaguugucaggacucaaacuacuuaaaacaauacuguaaauucugguaaauguuacauuuaguaauuguaauuguagucucccuagauuuguuuuccuugaagguauuugaaguauaugcuuuucuugguuaaucuuacaccuuggauauggccuugcuuucuuauguucucuagcgucauguaauaaacucaaaagaaagccaacaagauccucccaggaccuuuaauaguuuguuuuuuaaauuaugcuuuauuaauuugauacuguuuauucuuacuccuuuuuuuuuuuuuuuuuuuaaaguugagauacuuguguagcccaagguggccucaaauucacuaugggaaaggaccaaccccugacccugggauuaacaaugcuaccaugcccaacuuuacuuauuuuuacaaaagguuuauuuacuauguguaugagugugcgcuugugugagucuuuuugcaccacaugcaugcaagugccuguggaagucagaagucaucaaauccccuggcaccggaauuacaggugguucugaguugccauuuaggugcugggaaccaagccuagguccucuucaacagcaggaaguaccuaaccucugaacucucucuccagcuccuuacucauuuuucuaaugcuauggauugagcugagggcaugcuuaacacauggucuaccauugagccacaccccaucccuauuuacucugcuuuagagaugccucuaggugcagaaauucacagaaacucauuauagagcagaaugaauguuaucauuaggcugaccagauggcucagugggcaaacugccugucacuggaaccucacaauugaucuuagauacauagugauaaucugucaaaaaagaaaaggggaguguggguggggaggggguucagaagccacacccauguagaacccauguagguagaacauauuucugaaagcuauccuaugauuuauacagauaugcaauccccucaccccaaugauaauagauaaaauaaauucaugaaaaaaguugaucugaauguuucuauguuuuagccuuaguaucagugugaaaaaucccugauguaagcagucugcaggaggaauuacuuauuuugguucaauuuaaaucaucauaacagggaaggcaugcuugaacaaaacagcucacauggugauggcuaggcaggagaaaggcgagagggagaaggagggggaggggcugaggugcucuuguccuuucccugguauucuacccgugucucccagcguauguauaggaaccauguggacuacacccaguaggggcccucuuccugugcucgguccuuuuugugaaacacuccuuccaggugcuucuccaccuagucacauuaauagccaucacaacucuuauuuuucaaaaccugguauuuuccuggguuuuggaugucagaauaaauuauacugguauccuuuggagagcucuucuuagaauuuacuaggaguuauacucagaaauaaauuugcuuucuugaauucauucgauuacccuaucuguguguauaugucucucuguguguguaacugagugcugauguccacagaagccagaggcaucaagucucucaggaacugaaguuauaggugaucaugagccucccaccaugggugcuaggaaaugaaguggguggaguucucugugauuaaaugaacauuguuucucuugcagauuuuuuggaaggguguagcucagugauagaguauuugccuaacauacagaggaccaaugcuugaauuugaaauuucuuguugccaacugauuuauuuuuauuuaucuauuuuuauuuuuuauuuuuuugacuuuugagauagcauuucucugugcagcacuggcuguccuagaacucucucuguagaccagguuggccucauauucacagaucugccugucucuguugggagguacuggaguacugggauuaaaggugugugcuaccaccaccaagguagccaacuguuuuuugacaaguaaaaccuucuucccucccucccucccucccucccucccucccucccucccuuccuucucucucucucuuuuuaauaguagagcagugcuggggauugaauucaggugcuugguuuuauuuguaauuugagaaccuaugaagggaugugucaagcauuuguagaaaaucagacuuuggaauucuuuugcacaguagagcuuccuaauggcuucaguuggaugguguguguuuuuguguguguguauguguguacacuguauguauggugaacguuuucaccagagauugcuguccggugucuugcucagcuacuagucaccuuauuuuuugagaccaagucuuuugcugaucuuagagccgcauugauuuggcuaugugaguuucagggaucuguauguugcugucucuuuagugguaggauuguagauaaaugcuacacccaaccuugauuuggcuaugugaguuucagggaucuguauguugcugucucuuuagugguaggauuguagauaaaugcuacacccaaucuuuuacuggugcugaaaauccagacugauguccugaugcuugagugacaagugcuuuaucaacugaaccaucucuccagucuuucaguuggguacugguuaauaaaauucacagaagaccauuguuuuggacugccuucuugcacaagaccacagaagauagcuugugccagaugcugcuaaucagcugaacuccuuaaugggccaguuaaaagacaaagauaucagccagucagagaggacaguuuaucuaagccagcaaaaggaagacucccuguauuaauuauuucccucccucccucccucccucucucccucccucuaguccugucugucuuggaacucaguauguggagcaggcuacuugaauucacagauuugcuugucucugccucccaagugcuugucuguauuacugaucuuauaaggaaaauaaacuuaagacagcuguccacuuuuuuguuucuuccuucuuuagguuucauuuuucuguguaugugugcgcauguaagugauggcgugggauuguauguuguucucaguugcuuucuacuuuuuauuuuuugauuuuugagacaaggucucacuguguaucccuggucucaaagagacccuuuuugccucugccuucugaguguugccauugaagauaugguccaacacacccaguuccaccuuagucaacuuauaacaguucuugggccacaugggauccagagauggaacucaggucauuagguuugguggcgugugcuuuuacuuagcuguguugccagucucacuuuauucuuuuagacaggccucucauugaacuggagcuugcaagguuagauuggcuggucagcuagccucagacaucuccuggauuaaaggugcaugcagaaagcacacgggugcuaagaagacucagauacuaaaucaugugguggagccccuagauuucuucuuauauuaccuuuuaauaucuuuaaaacuaaucuuugcuuagcugauuaaaacauguguccugucuuguagagugagauguuaccaaauuuuagaacuauaguuuaaaagccuuuuaauuacugggugugguaguuugaaugacccauaggcuuauauauuagaauuuuugguuccuaauuggacuaggaacuagguggacuguuuaagaagaauuagcugggcagugguggcacuugccuuuaauccuagcacccggguggcagaggccagugauauaugugaguucuagucuagccuggucuacagagcuaguuccaggacaucuagggauacacaaagaaaccaucuuuaaaaacaaaaccccaaaagcccaaguaaugcaguaacaacccaaaacuccagaaggauuaagagguaugcccuuguagaggagguaugucauggggggugggcuuuuaggguuuaaagcaggacagcaggcccauacucucccugucuacugccuguggaccaggauguuaauaaguaagcucuuagccacuucuccagagccaugccugccugccugccaccauucuuucauggugguuaucaacugacccuuugaagcugaaagcaaguccccaauuaagugcuuucuuuuuauaaguauccuuggucaugguaucucauuauagaaauagaacaauaacuaaaacacugggucuuagcugcagugccacuuggaguuggcacauacuuguaaucccagcacuugggaggcugagugauugcucaaaggucagggccagucuggacuacauugaauucaagaccaggcaaggguacauagacucuuucucaaacaaaacaaaaacccuaaaacugaaauuacaaccuauaacaaaccaaaaugaaaguuacuuguaauccucugcauugaaguagauuauauggauacaugaaaauaccaccaugaaaccuauuauuuuguccaauugaauuaacaaaaguaauaaagccaguuaagauccuuaaacuaacuguaauucugucuuauugcaguauuagcuguuaacaguagcuucuguuugcagcuuguuugauaaacuggacucgaguuaacugccagucaacaguuuacucugcugguucuguaguuucuucauaguuguuagaguuccaggucugagcauaacuucauuacacggauggcacaucaaugaauaguggaucugaugauugcugaauugcccagauggccacauuuguuauucaggaaauagaucuuagaggccuguuauaaguuuaacacccuuaaauacagaggguagaugggugacaugaaaagaaauagggagcuaagagugauggcucagggguugagagcacuugcuaugcuuuuagaggaccuggauucauuucccagcauccacaucacagcucuaaacugcuuguaacuccaguuccagggcauccgaugccauucuugucauuguugugguucauaggugucauagcugggcaggacugcugguugcuucccaccuuugaaagcuugcauggugccuucugguaccaugccucagguaggaagcauuuaggucaguuucagcucagaggucuuugggcccuguaucaugcauaaugucuucagcaguagcaacuuaauuuucaccccugggguaggaguguguagccaagggcaguagcuucuaauaucuugggagucuauuggacagccuugaccaacaacucaaaagauggcuucucacaccugccuuggggguuuuuguuugauggucuuugauucuuggagggaguagcaucagcccagaugcaaaauuuucacacgcagacgcaugcaugcacuacaauaauucaccacuguuuucuugcugaacugcaaacaacugucacugggaaccaugaaaauaaagauaaaaaauucugggauugggaaagcaauagagaagggaauaguggaguacagugauuuuaucagggaaaugggaagagggggcugcaugugugugugacauguguucacuuggcauguuugcauggcauguucaggugcaugcacagguuuguggguauuaagugugauaucaaguccuccuugaucauucuucaccuuauauauugaagcaagaguuucuaacucaaccuggagcuggcauauuuggccaaucuagcuagucagcuuguucuccugggaucccuuugcucuaucccgagugcucagauuacagaugugcugccacaccugucuggccuuaauaugggugcugggaauucuaacucagguucucauacauguguuaaaacacuauccacugaaccuuuucucagcccuccaaugaugccuguccccuccuuguguuuuagaauauuacacucuucaagggucuucugaguguucagauucaagccauagcuccuuguaauacucauuuaagauuauugauacauaggauuccuuuacuuauugagacagaguuuugugugucugaggcuggcuugaauuuacuguguagucuuaguauaacauugaacuucugauugucuugcuuccacuguuagcugggauuagagguauguaccauugugcauaguuuguaauacauagacuuuaauauacuuucacuuuaacagaaauuuuaaaaguacuuuuuaaaauuuaaaauuuuaaaauuuaaaaguguguguguguguuucuguuguguacaguuguuuuccgaguccagaagauggaauaagaucuggaacuggcaguugugagcugucuggcaaaggcuggaacugaccuugauucuucccgaugagaagggaucuuaacccuuagccauuguuccagcucucacuuagugaauuguaaaauguuuuuaucacccccaaaauaaaacuuauuagggaaccacuaaucugccuuuuacuuguucuuuguuucuguucccccauuccuuauacuuuuuuguuguuguuguuuuuuucgagacacgguuucucuguauagcccuggcuguccuggaacuuacucuguauaccaggcuggacucaaacucagaaaucugccugccucugccuccaaagugcugggauuaaaggcgugugccaccaccucccagcuccuucuuuccuuauaguucucuuucuuucucuuaucuuuaucuugcuguaucuagcuggccucacacuuauagcuuccagguagucgucuguccuuagcuuucugagaagcagggacuaugggcacauuaucauauuauuuauaugaauuugccaauuugagacuuuuguaugaauagagucaguauuuggacuuugccuuggcccaaugucuaacauugcuguguuuucacaugugcggugcugucucccucacugugcucuggacaaccaaaacucaagcugaaagguaauuguugaauaggagucaucuuuugcuggucuggguucauugccaugagagacuuuuaaaaauuacuauuuauuuuuuauuuuuuauuuauauguguguuuugccuguaugugugucugugcaccauguacuugccuggugcccaugggagccagaagaaggcaccagauccccuagaacuagagauacagaugguugcucacugccauugggugcuaacgacugaacccagguccucuagaagagcacccugaggcuugagcccucucuccagcuccucaagagugacugcugaaagcaugaagguccagagcuuugucucuggcauauacugcuucccuucugccuuuggcuuugagcugcagcagaggcccugagcagaagucaagcagacacugugacauacuguugccuuucuagccuccagaccaugagccaaaauaacuguacaaaugcugucucauguucuguuggaacaacugaaaauggacugacacucuuguccucaguucugcuuuucccaguauuuuccuauuauuaagaacauaccuguguuagaugaguucuuaaaauauuagcuggacaguuagaaaugaacaauucuugaguuuuaaauugugugccauuugggguagcaugaggaaaucuuacaucaucuuuucuguccugccugggacacgagucaucuucugguucagcaugcuuguguagaucuauaugcuucccuccagucacauaguugcugucuugcuaucagauccucugugugguauugcagacugguacucacacuaaccccugccccccccccccguuuuuuuuuuuuuuuuuuuuacuugauaauggcucauuuugcaagaggauaaacugaagagaagcaauaagaaaccuaagaaaagaagugugcaaacuguagacaucugugcugcgaaggaauaagagauuuguuccagcuuugcuguugugccucacaguuguggccauccugcaugacaagcugggcauuggggaguuugacuagaacuuauuaaguacuagcuaugggcccuggccuuacugaggucugaaauauacaccugcagcaugagggacuucucuacuagaauuuaauuccuuuuuuuuguuuguuucuuuuaaaaaaaauacuuuuauuuaaucuuuggcaguaucaugcauguguguauauuuugauccuaccuuccaacuccucauuacuuuuuauaaucaaguacuacuaaucuuuuguuuagauaaugucuccuugucacuuaauggacuuugggucccugccccccuuggcuauuuggaauaaugcugauagggaaucugauguuuuaagguuaguaacaccacuugggcuggagccguggcucagcacuucagaaggcugcuuguucuugcagagcaucugguucaguucccagcacccacaguaguugacucccaaccacuuguaacuccagcuccagggcaucuacagcucuggccuccauagacaccuguauucacaugcaaauauccugcccuccauacacaaaaaugauaacaguuuuuaaaauuacuuggaaguccuauaauuuuaguugauaaaaaaauuguucuggacagacuuuuggaaggcaaaaggauaauuuuauuaggcuuuauguuguacauugaagauaggauuuuuuuuuuaauuuguaaauugaugucuccagaucuugagacuucaugcugggaguaggacuugaugcaguguuacccauucuugcugucacaaggaagaaaccacuaagaaagauacugaggguuagguagcuguccuaggaacuucagauuuaguaauuuuaguaauguuccacuuuuaaugaucagcaugcuuuuuuuuuaaaugacauaauaaauucaguuaacuguaacuaaagaaauggcaaaauauauguacaauaaaguuuccuggguauacuggugcauauccuuacucccacccagcacuuggcagguggaggcaggcagcccgccuggucuccuacauugcaaguuacaggccagccaggguuacauagcgagaccuugucuuaaaaaaagagguuauggcuguagagagggcucagcaauuaagaacguuggcugcucuucuagaggaccuggguuugguucccaguacucacacuggcugacauauagccaccuguaacuccaguuccaggagauuugauguccucuucuggccucuauaggcaccaggcauguacaugaugcacagacauacauucagacaaaacaccaauacauauaucuauaucuauaucacccauauauauauuuauauauaucacauaugugauauuuaucuuuaauuauauauauaauaaggauauauauauauauacacauauaaauuaaagauaaauaaaauaacuuuuuaaaaguuaaccacuuuuaaagauuuauuauucuaugaguauguguguguguuucuguguaccacaugaauacaaaugcucucaggccagaagaggauucuggguuccucuggaguuacaggugguucaagguuagcuuguguuaaucuaaaaauuccagucuagucuauagucuagauccugagucaaaacaacaaugacaaaaaacccgaaccaaaaguugagacuguuuuggcuucucugugucauuuguguuuccauaugaguuuuaggaucagcuugucaucuucuacaaaaauguuugauuuuuaaaaaaaauuaaaaaaauuuuuugucaccuugacacaagcuagaauaauuugagaagagggggccacaguugaaaaaugcuuccauaacauuggucuaccugugggucauuuucuuaaucaguaacugauuaugggggagcccaguccacugugggugguccugggaguauaagaaagcaagccaggaggagcaagccagcaaauagcacucuuuuuauggccucagcuuuuuuuguuccugccucagguuucugucucaaguuccuaccuugacuucucuggaugauggaauacagcuguaaaaugaaauaaacccuuuucuccccaaguuuuuuuuggucaugauauuuuaucacaggauugaaaccauaaauagggauugauugaaaccccuagaugaauguggagauuauugccccuuuaacagugaccuguguauugauacgcauggcccaacaugcucaugaguuugucuguuuucaguuuuuuuaauuuaauuuaauuaaaaaauuuuuuuuucuguuuucaguuuuaagaaccccaugcccagugucuccauuuaagaucaaguuccagcuuugauucugcuguaauuuuucaagguuggggcuagagugugagggagauggcuguuaaaugaacauaaguguuccuuuaaagggaaguguagguugugcaucucacuuugcugaaagagaacucuguagacugcuugugaacagucagcugugcugguacacuugugugaucccugaacuuaggagguggaggcuagagaggcuaggcugggcuacaaugagguccccugucuaggaaaacagggugggcaggggaagccacgcagcuuuugaaaugacccuugauguuugcuuugaggcaggagagaugacagaggacaggcuuuguuuagcaagagacugcuggagguacaggagaguggaagugaacugacagacuuuaggucaggucuagaauuuuauggugauuagguuuguuuaaaagccugggguggggcuggaguucuggcucagagguugagagguuaaguguacuggcuggucuugcaaaggacugggguguggucccaguccucuuguggcagcucacaacucaauuaucaguaacuccaguuccaggggcuccagugccaucuuuuagccucccugggcucuaggaacuguuaaguacaaggucauauuauguaaaggacaucuuuucugcuagcauaguguuccacuaaaggccuuugccuuucucaccuaacagaagagcagugagcugcuguacuuaaaauguacugcauugcacccaacauguauuccuucauuuugugcaugcaugagugugaguguguguuugugccauggggcacauguggagaucagagggcagcuugaugcugguucuuaucguccaccgugugaguagaggugaucaaacucaggacaggguugaugucaagccgucuacacgcccagcaucucucuggcccucccuaccuuuuacauuuuuauuuauuuaugauuauuguguguuuauggcaugugacugcauaugugcuugcuaugguucaaauguggagaacagaggacaacuuaauaagagucaugugucacuuugcacuauggcuucuggauauugaacucaggcuugaaugacaagugcuuuuacccaagagagccacuucguuggcucugguucacuauuuauauuuauuauuuuaccucaaaucaaggaacagcaguguuauauaagaacuuguaagaauguggagauuaagcagagcuccuaggagaguugcauauaauauuauacuuucuauacuauuuugguaaaaggaagucagcaguguuacuuuaguuaacuaucugguuucuccagggcuuugagcuagauagaaauuaggaaguauuagagaaaugcaaacaaagcccuucuagcaccagcugaggcuuucucccccucaaaccccuguuagggucauugguuguagucagugccuugccccauauuccuuaaagucauccaggagggauguguccuguguuuugugaagugcugcccuguuggauuaugucagucauguucagccaccaggaaguucucagaacccagcacaagccuuacugcuuccuccauggggaagauaauaagcuuacggggcuaaguucccagaaaacaaaaguaaaacaaaaagcauaucuguguagaagguuucuagaagacugaauuagaacuucuuuaauuguggagaguuagaauguucugagugaauuaucuugggcuaccuuuaguccucuuaauagucauucauuguccaagcaucuauuuggucaaacacuuggauaucaagcaaaaccucugaacuguccucugaacagaccuuuagguuccacccauccccagucucacuguggcuuggguggaucuggagccuggaguagaacgccccgcuccccuugcauccucuugcucuguuccugcuggugaacucaguuaguacguugacauaugacuucuuucccuuguagccacuucuaugaugaggcuugucauuugaggccacauaaguccucguuccuaggcugcugccacucauuuuuggcuuagaauaaauucucucucauuccuuugaggugagcugugcugugcuguguccugucagcaggaccauaggugcaugggaacuuaauuguggguuaucugcuguuucuucuuuuccuuagaagaaaagaaaagaaaaacauuuguguauguaaacauugcuagugggaguuugauguuucuagacucaggucauuagggguuccuaugucuggcacauguaugccucuucuggccugcuggcaauuuccuuugcuucuuuccuauauucagugucccauugcuuccugugucuuaaguucuuuucucucuugacuuaugugaauaaugaggcccuucagaaagcgacauggacagccaagcucaugaaucaugaauguuaaaaagcucucucuuuuacccuuccuuagaguuuucuuucauauuguacugacauuucuuccaauguugagacuugaagccauucugauuccugauccuuuggcgaaaacuucugaagucuuguuuucuugucauuauaaaauaagugugaugcauucuuaaucugauagaguucagguccccauccaugugcuuuggucucugguccuuuauuuuauauuggaaguucucugcuaaucucuuuuguuaacaggacaagauuaagaacugacuguggucuuagagcacaggugagcuuuacugaacauugugguaugauggggaagcucagcauguucuuugagucugguugcugagcuggggaggaggcugccgguuuuugcagucagauguugaguuaguuuaggcucaaguguugggccuguugaaguagcaucuggucugucuuuacaguccauguuggucuauaaucagagcucugugugccuccgcccagcugauggccugggucuuuugguuuguuuugagucuugcuuuguauaucaggcuggccuugaacucuacaucuuccugcucuguugggagugcugggcauauacagacuuguaccuguacuaccuggccugcuguggucugucucuuucuuucuuccuuucugucugucugucugucucucucucugucugucugucucuuucuuugcugagucaccucuccaguucuguuuuucaaaggcauauauauaaacauaaguuuaugauuaaauacuagaaagaaucaugcgauucuuaggcauguuacaggacuggggauguggcuuggugguagagugcuuuccuaccuggaagugugcuguguggguagaaggaaagaaagaaaguuacacccgguaguguuggcuucuuuugucugucugugucuuuauccucuguaaauuugaaaaguguuugguacuucugagagaugaagcaguggcacaccgccugccccccagaacgggaugacaaaaaguagaugccuauugacuagucauuuaaacaaacugaaaggccuuucuuaacauaaaaaucauccaaaaucuaauuuuaaaauguaagaaaagacaguauaaauuuuuauucacccaguuuuagugagaauuguauaugagauuacucuuuucaacaucucauuugucuauucccuagguguuugucuuucuguuucagccgcgccacccccccaccccccuuuguucgacuuuagccugugcuaaucacuuuucuggggugagugcucacauggcaguguaccacagucuuuccccacugcacauauucagaguacauggcaucauuuuucuuucuuuuuuuuuuuuuuuacuguaaaccugaacuacuguaccaucugcugacuucuauagcguccguguauacucugaacgucaucgucuuuuaggguggguguauuucuaaugcuaggcuuuugucucugcucuuuggaaaaaggaaaagauaaaauguucuugaguuugagaaggugcagucugugguucugcuuuggucagaaguuacaaagaauuaaacuccagcaaugacugaaaaagggaaaagcuauauacaauuguauugauguaauaaucccugccgcagacaucagcagacuacuauguacuucauggcgugggguucucuccaagggcagugcuuacccugacuuccaacugcugagccaucucaguccacccaauaguucuguuuuaaauggaaccugcuugugacuauaauuuuauguuguaucuuauagcauuuucuuaguacauuuuaauauuuaguguuauagacuuagaaccacugcuguucaguuuuuccuuuccuuuucuugcuucuguuccuccuccugucucuucuccuccucuuuucuucuuccuuuuuucuucugcuuuuuugagucagggucucuguacagagccugacuguccuggaacuucuauguagaucagacuggcuuacuuacagagaucugccugccgcugccuccuuguguugggauuaaugcuugauuuugacuaguuuuuuuaaaauuucaguugauagcuaacuuugguugauucaaaauaaucauaggaauuauaguuaucaugauuggugaguagacuucugccacuguaaaaucaaaccacaaugauaaauaaggucauccaauaacuaauaguuacugugaaaagaauaaaaauuuagcagccgggugugguggggcaugccuuuaaucccagcacuugggaggcagaggcaggcggauuucugaguuugaggccagccuggucuacagaguaaguuccaggacagccagggcuacacagagaaaagaaagccugucucgaaaaacaaaacaaaacaaaaguuuuagugugccaccaauggaaugccugaaaacucaauaggauuacacaaagcucuggguuaggugccuuuguugcagguacugguccaaguauuaagaauauaccagugaguucugcucacagagcaaacauuuauaaacaguuuugguaaauaauaaaugucgcacugagaauuaaucaaguuuguuugcuggggggaaggggaauagacaguuuuggcuggagugucagguaaggacucuuuaaaaggcugucuugguugagacagauagugaaaaggcuauuugauuguuuuugggguuuucauccuuuugggugaagggaauaagaaauucugagguaugaaaauuggccuguucugguggguuugucuguuuucuuuucuuucuuuucuuuuuuguuuuuguuuuuguuuuugagacaggguuucucuguauagcccuggcuguccuggaacucacucuguagaccaggcuggccucgaauucagaaauccaccugccucugccuuccgagugcgccacuaccgccuggcugucuguuuucuuuuuaagacaagguuucacuauguagcccuggcugucugggaacugaguauuuagaccaggauggccucacauaccugucucugccuuccaaguguuaggauuaaaaguguguccaucauuacugguaugauggguauguucugaaagcagucuuaggggcuugauuaaggaguuuagauuuuauucugaguuuucagcaagagggugacaugaugagcugcuguuuaaagauuguuuuggugauaaaaaacagccccuacgaugucagauuuuuaguagguaguacauucugauucuucuccagaaaguugaccgagauuuaaaauaccacauagugaucuugauuaacuuuccaaaccgacucugcuuuccugacuuuaagguuacagauguuccauuaugugugcugggcuuuguuccugcaccccuauaacacagucugcauuugcucaggccccucauauagaggacauaguauuuacaugggcucugcauaugucucugauguuuaaguccacuucacccagagaacucaggcuuguuaaucucucucucucucucucucucucucucucucucucucucucucucacacacacacacacauacacuuuuugauuuacaauugguugagucuauggcuguggaccuacagguguggcacaggaguaugguugcagucaauccuuaauucauuuccugggcugagagucagcacauaguggggagucagguagaaaguucugguugaaaauggaguauagguuacauuuucuuuaauucuaggacauuuuaucccugacuaagugauuugugugucaggacuguaugugagacaguaagagcuguagagucagagcuccucauguguguaucuuagccuguacacucagaaguauguuguaagaauuuucugugcuuuagaugggauaucacuucuacuuaguaucuaacuguacguauuaagguggauaauaggaaugaggcauguauauacauaaauuugcguaugugcuauguaugcacgcacauaugcucuguaucccaccccauaauagaggcuccuggugaguucuagcuccugcuggauaagacaaaagaagugucugacauaaggcucaaagggagauucucacaguuuucuaaaggaggagagccauuacuuugucuccuugcugacuugcaagugucugggcguuagucuuauaccugaggcgcguuccauaguuaacacauauguguuccauaguuaacacaucagauuaagcugguuagauggccagucugcugcuuugguucugcacucaaacuaaacccugaauauuacaauggaaaacucagacuuuguaaguagauauggaaucugggaguuugggggcagcagcuaggaugauuucuuacaaagaguagaaggaagaaauaaaucacuauauuucuuuccugacuaacuugcucacagauuacaaaaaaagccauaaaccacuguuuucacaacuuucuauauuguguucuuggguuaaguacuuuucuucuagaauuauaauuauuugucuuucagguauaaguauuguuuaaacugcaucaauggagcacauacagggagcuuggaagacgaucagcaauggcuuuggacucaaagaugcgguguuugauggcuccagcugcaucuccccuaccauuguucagcaguuuggcuaucagcgccgggccucagaugauggcaagcucacggauucuucuaagacaagcaauacuauccggguuuucuugccgaauaagcaaaggacugugguaugugacccuagaaaauguaguucucuuaccuuuggagacugugcuaugcuguccaguuuauagaugggagaaucuccuugucacuugggaucucuguuaaucguuuuuuuuuuuuuaacucccccaagugaagauuuauuuuuauuuuuaaaaagacuuauuugggguuugagauggcucagugguuaagagaacugacugcuuuuccagaggucacgaggucaaaucccagcaaccaaccacaaugguggcuuacaaccaucuguaaugagaagcaaauaauaaaaaccuaugggcuggaugugggggagggggagguggaaagagcugggccggagcaagagggagaaggaaauggggggaaaaaagaaaaaaaaaagaccuauuuguuuuaugucucucucucuauauauaaguguucugucuucaugcauaccaaaagagggaaucaaauccuauuacaggugguugggagccagcaugggugcuggagaucaaacucaggaccuguagaagaacagucagccgcucagauuuacuuuaugaaaucacuguucugcucacucucuacugccuucaaacguggcccacaaaagccuuuuucugcaucuuuauuuuugggugaggaggagaggcuauuucugauacuuuuuuuucuuuugaaauauuuuuaaaauuguauuuauuaauuuuguguguguucauguguguguggugcuugcauauguguacugcuacaguaugacauggaggccagagcacagcuuguaugaggagauuuccucuuccauuaccacauggucccuggugcugagcucagacgguccagguguggcagcagcuguuugccuccagagcaucuuguuagccuuuuuuuuuuuuuuuuuugggagaaguuuuuuuuucuucuucuuuuaguuuccaagcuaauuaaaacuaauuaaagaaaguggggaaagagacauuuauucuucugugaaugcaaaguauugacuuaauuuuugagauugcauuaaauaugaggaaaauacaauuuucuggguuauuuuacuuuaggaaaaaagucuagauuuuuaauuuugaaaaaaauuuaguuuuuguuuuaugugaguggguguuugcuaccugccauguaugucugugugccaguguguucagagcgcauagaggcugggagaggacacuggauucccuggaacuggaguuacaaacuguuaugagcugcuacguggugcugggaauuaaauguggcugcucugcaagaaaagccagugcuuuuaacuacuaggcugucucuccaucuccuaggaaaagauauuuuauuauuuuauaggcccaagauagauuuuuagguugcuuaagaagaaacuccugccuugucucuucucagggcacaaaauauuuuugcauuuuuccauggaaucaaugacagguccauguuggaaccagauguugucaacaggauuuucugacaggaaaccccauuauuuucuaaggacccacugcucaaaacccuuuacuguucugaacuuuaaaagcaaaaaaccaguuugacugaaacagaaaagugaaguuauauugguuuuuguuugucaggucuuguuuaaccuaaauuuaaaacuuguccauccuuguggagcacaguaugagacauuuguuuguuccuaagguugggaggccagccagagcuuucuugguuuucuucugacaguccccucugguucuucuuuucuuuucuuuucuuuucuuuucuuuucuuuucuuuucuuuucuuuucuuuccucuuccucuuccucuuccucuuccucuuccucuuccucuuccucuuccucuuccuccuccuccuccuccuccuccuccuccuccuccuccuccuccuucucuucucuucucuucucuucucuucucuucucuucucuucucuucucuucucuucucuucucuucucuuuuucuguuuuuuugagacaggguuucucuguguagcccuggcuguccuggaacucacucuguagaccaggcuggccuguaacucggaaaucugccugccuccgccucccaagugcugagauuaaagaugugugccaccacugccuggcccccucugguuuuucuaguugauuccuucauccuuauuuauuuuguuugugugguuuguaccugaguguaugucaguguaccauguauacacagcauccauagaagccagaagaggacauuaaauucucuagaucugaaguuugggcuacccagugcuuucaggguucauaggcagcuuaguaugagauucaaaagaaauuaauuuuuuaauuaauuaauucauuuuauuuauuuuuuaaagaagaagguugcugaguagcuaccuuaagauuagggacacgguauuugugccaguuaguugugcuggcugcugcuucuccuuucacuauuucuccacuuacuuuuccacucuggaguccagauucacagaugagguauuuuaggaacaaaucugaagugccaacauuagaucauagaccuucuagcuugugcucccuucccuggauccagaacuuugaguuguagguugucuagggcauuccuccaagacaggaccauguuggcuaggucauauggaaccucccacuuccccuaagccuguaagaaccugagaaccuggccuuuguucuucuugacugaagauacccuuucugucucccuuguugcacuucuguaguacaauaacuauuccaacucuccuaauaccgucauccuucuuuagggcuacaauggcugguuaugccugugagcucauaacugguggauaaaauucuuucaaaugugucaugucuccaccaaccugcaguaauuucgaauagccagcagaucuuuuuagcuuauuucuccagggauaaaaaagaaaaucuucacuuguuaguauugcuuuguacaagcaaagccauuuuaauauuaaaagaguaaaaaggguuauuucaagaugagaauggauucuguucgaauggauuguguaucacaugacagauaauucagcauuucauagauggaguuacucuucauggugcugaacacugcaauuuagaaccagauuuaauacuuguuucggguccauuuguagauguuaaaaacuaagagccauugaggcugcagagauggcucuacaguuaagaggguccuggaguucaacuagaagcaccccaguuaagcagcccacacucuccugcuccagggaauauuacauguauagccucuguuacagugcacaugcauuuauguacaccuuucucugggaaaaccagugguggaaagugucuucuggcagccaguacccucaggcagccagcacuccccauccuagaguggcuucccaggauuucucuucuuacagcucagugagacaccauugaccaaaucacagugugaaucugguggcaggagagacagacugaggauguguuuaaccgaaacgauuuuagaaggauacuugucuuuagaagaauaauagucuuuuaauguuucuugacauuuuguuuucuaaacaugcacgucucucugacugcugcuucucauuguuacuggacaagugaguuacuagaguugagaacugcugcccuuacaaccaaccaccuggcagucaggaauagacacagguucuuggaagcagacuccuuggauguguuguacaggaggcuagggagacucuuuuacaaaccccuuggcugcuucccaugcugucuacaucuggggacauuaguggaguagagaauagauuaagagcuguucagcucuuagaaucuguugugacuucuauuggaaauauuaaaauaaccacauaucacuuuacaguuuugaaagcuaugcucugcaguauaggugcaugagucugucaaugugugaguuuagcacucuuuguuuuagcacuuucuuuucucaugucuuuauagcucagaucucuagugcaggcaugucugccucguuuugcuacacacuaguaagauguuauaaggguaaauaccuaugaaaguaaagagcuuacaguaacaguucugguauguuuaucaccuggcuuacccuuggcugaucauagcaguucuuuuugucuguuuccacccacaccuuuucauuuguuuugauacaaauccuagauagcguuugucugaacuaguuugguauguccaaggaacuuuuuucuuuagacagagucuaacucuguagucuauacuggacuuaaacucaaagcagccaucuguuugaaacucuuaaauguugggaauagaugcaaaccaccaugaagcuauuagaaacuuacauaauguuaauuguuuaaauaggcaacaugauuuacaaguaugggugacuucugccccugucuaguuccccaguucuuucccuuaguaugccugugauaaaaaagguuuaucaacuugaagaaucagauggccucauccacaccaaaggaggaguuugcuuauuuauuuauuuauuuauuuauuuacaucagaucucauuacggaugguugugagccaccauguaguugcugggauuugaacuugggaccuucgaaagagcaguuugcgcucuuaaccacugagccaccucgccagcccaaggaggagcuuuuaaagcuuagaaaacccuuuucuuuuuucugucacuaaaguggaggaacucugaucccccgcuuccuacucacccucacugcuuugacauuuguuaggaagaucaucucuccauuuuguugaaagugggcucaucucauguguguuucaccuucuguccaugcuucugugcacuuaugugcacucuugcaaggccagauaacuaaaugugcuaaguaucccuccauaccacuuaaaauuauuuuaaaaacguauuuguguguguguguguguguguguguguguguguguguguguguguguguauguauguauacauacguguguauacacucgugcaugugugcuccauggugcauuuguggagaucagagaauagauaacuucugggaguuagugucugcuuccaccauauuugucucagggauugaacuuaaguugucaggcuuggcgggaagcaccugcccucuaauuuuaauagcaagguguaugucuuucuaacccacacagcauacauaaacauauacugguuuccccaccuuuaaaauagucuuacucuugagcggaggcuuuggcugcgggggaaggaggacuaugaagcuuccgaauauccugcucaccgguacaccagggguuggaaaaaccacucuaggcaaagaacuugcaucaagaucaggccugaaguauguuaacguggagaucuagcucgagaagucugauuagcggauaucauggagucuggcaagauggcgucucccaagagcaugcugaaagaugcacagaugauggcacaaauccugaaggauauggggauuacagaauaugagccaagaguuauaaaucaggugcuggaguuugccuuccgauaugugaccacaauucuagaugaugcuaaaaucuauuccagccaugcuaagaaagcuacuguugaugcagaugacguacgacuggcaauccagugccgugcugaccagucuuucacuucuccguccccgagagauuucuuguuagauauugcacgacaaagaaaucaaacuccuuugccacugaucaagccauauucagguccuagauugccaccugauagauauugcuuaacugccccaaacuguaggcuuaagucuuuacagaaaaaggcaccugcuccugcaggaagaauaacaguuccaagguuaaguguugguucaguuucuaguagaccaaguacucccacccuaaguacaccgacuccacaaaccaugucuguuucaacuaaaguaggcaccccaaugucccucacaggacagagguuuacaguacagauggcugcgucucaguccccugcuguaaaagguucuauaccugcaacaucaacaguucagaauguucuuauuaauccauuguuaauuggguccaaaaacauucuuauuacuacuaauaugguaucacaaaauacagccgagucagcaaaugcacugaaaugaaaacgugaagacgacgaugaugaugaagaugaagaugaagaugaugaugaugaugaugaugacuaugauaauauguagucuaaccacgaugcauguaaccuguguucuuggacuuggauccauuguacuacaaauuaaaaagcauguuagauguuuuaaagcuguacuuuagaaagugguauuucauaauuauacuuugcuuuuugauuaaaauguucaguuuuacuagaacuagugaugguuuuucaucaaccuuuauguacaaaaaauaaaaugucauuuaucaguuugaaaaaaaauagucuuacucuuuauauuguucuaaugaaaguauuuucccuaguaaacgugccguagacuacuguccccuuaguaacuaauuaaggguaguuaguuaguacaggagaugcauaauguuccaaugcugauucaggccuaugugcaucugcuuauacuuaacucuggauauugagguguuuuucucuguguguucacuauugcaaacaguaugucauaagucuauaccauuuuauaugucgugcguguauuucaguguuuaucuuugcgaguggugcuguagccuacacugguacuaaaggggaucauuuguuugcaggucaaugugcggaauggaaugagcuuacaugacugccuuaugaaagcucugaaggugagaggccugcagccagagugcugugcaguguucagacuucuccaggaacacaaaggguaagagcaaagccagccagcaccuuuuaggauucuaagcguuuccuagccacaaauaacuugguauauuacaaugcuuuguauuagccuccuagggauuagugcauguggauauacucuguuuucaaaguaucaauucagaaaaauugccucugagaacuugaaauuauugccuggacauugucuuaaaagcuauaauaaaugggaggugcuaauagcauuguccagggauggaggcagcauuguuagaaggccuguuuuugagugcaaagacuuuuccugguguuugccaugcagaguggguacucugaacaugacugcacucuuuuuuaugguuaagaaugcuaggggcuaaagagauggcucauuaauggcauuugcugcuccucagagaacucaaguucaguucccagcacucacaucaggugguucacagcuaaugguagcucccgcuccaggagauuguaugccgccuucuggccuccaaggggaccuuuacacacaugacauacauaccacuuagagacauucagaaaaaccuuucuucccucuccucuuuuuuuuuuuuuuuuuuuuuacauaauuuuaaaagauuuauuuauuuauuuuaugcauauaaaauaaauggcuucauguacuuccagaagagggcauuagauccuauuacagaagguuguaagccuccauguaauugcugggauuugaacucaggaccucuggaagauuagccugugcucuccuccccucuucuccgcucuucuucuuuucucucccuuacccuuugccuccaaucccuugucccuuuucaucuugggccugaagaaauacacuagucaguauagugcuuccauacucucugauugcccaacugccauaacaccccguguguggcugugcccuuggaaccucagcaccuggaugucuccagagacauccagagacaggcaggucccugaagcuugcuggccugcuuaccuaauugcugugcuccagaucagugagagaacuugucucaaaggcaagauagauggcgcccggagaacaccacuucauguuucauuuugucuugcuacauuuacacauuuauugcaguucuaaagagagauucuugccauucauucauucauucauucauucauucauucaugcuuuccucaucuaucucguuguuguuguugcugcugcugcugcuguuguugcaguacuggagacagaaccucgggccuggaauaugcuaaguauucaguucuaugaguauuaaaucuuggcucucugauagccacagggcugaaagagacagggaauuucuacuuccaggaaaauacacuguauuuccagucgugguagcaagauagagaugguuuucccgucuucaaagacugaaaucauggcccauagccacagagcaccauauccguacuguuauuuacuauggcagcccagccuuugacuuugcccucuuugggaagcagugcuucugcugcuaaccucuugcuuguucucugugguugaguucccuggcuggagagaacaucucaggagagugucuccucagaguuuacccuccgagugucuguucuucuguuuauuuagcuaguuugcugaucaucaaugugucaccacuucuggcuagauugauuuuugugucuguccccaaacugauacauagacuuccuucaggacuagggagauucuaagauggguucacucuucuucaagcuguacugauuuggaacuggucucuguccucuccuaccuauucaggagugagguuuccuuccuggucuucauuaggacacaauaguacuuuagacagauagauaccauuucccuaccuuaaauagggaauuaucuuaaagaaugaauuauugcucauggauagccagaagaguggcuuguugguuccuggcaggugauaagagggaucugagugaugucauaugugcguuacauuucuuaacauuucuuaaucggaaauauucauccucggcaaauggggcagaucugaaucagcuuuugcuuaaaucacuugguuaccugucuuccuuuuucugggcacagaaagaauggugucagucagguuuaaagacuguuguguuccuauagacuuguauuuauuuuuauaacuucuacaaacaacuuuaagucuguaacuaguguacagcacauuuguguuuguauuauauguauuauuuuagauugaaguagcuauugaacacuaaccuguagugacuugguaggauuuuaauauuaugcaguccccuuauagacaguuacucuugucaugagauuguuguauuacauuuuuaaagaacacuuuguucuaggagcauacauuuuggaguccaacaggcuuggguuucaacaggccacacagugagcaguguuggcuuaucuuuauggugggaccagaacaccugugaggugugcuuagacagcaugcaguagguaguagaacugcucuaugucuugagccuuguccaauguucccuuauguuaugcuuuggauaauuuuuaguaagaaagcacgcuuagauuggaacaccgaugccgccucucugauuggagaagaacugcaaguggauuuuuuggaucauguuccacucacaacucacaacuuuguaaguuucagcuucucccuuucuuugccauuuugggcucucuacaguggauggcugaccuuucagagaagcucugggugcacauuguuaguugcuuucagcucucccuaugcugucauguauuaccagaggccccucuacccugucucugaaucugacagucuugcaacuaugauucuucccuguggguacucugguaaggacggggagggcagugcuguguuugcuugucacucgaguucucacaaucccgcuuucuugucacaggcucggaaaacguuccugaagcuugcauucugugacaucugucagaaguuccugcuaaauggauuucgaugucagacuuguggcuacaaguuucaugagcacuguagcaccaaaguaccuacuauguguguggacuggaguaauaucagacagcucuuguaaggcacugugguuuuuuuuuccuuguaaaaaaugccagggucagguccagaagcauuuuugaggaugcucauuauacauuuucaauguaaagucugagcuuuagguuugcuaaauaaaugauugcugcgagucagaaacuauugacuuuagaagcauaauaguucugagauuaguuaguuuuagugugguggucaucuagcuguaaaauaaacagguagggagcuggggaugacucaguugguaaagugcuaacugugcaaacaugagagcugaguuugauuaccggcgcugacauaaaagcugggccuacaguguguaaucucagaguuggggauguggagacagggcuguccuuggguuugcuggccagcuacucuagcugagucauugagcucaaguuucagugagagaucuugucucaaaaaauaagguggagagugauugaggaagacuccuagcauugaccuuugguauucacuccagucauaugaacucagacacacaugcacaaacaauaccaaaagcaggcaggacccauugucugucaaauuguuacugacacugauuugucaaggaaaagaacagggacauggaaauugaagggcuaggcuuucuuuuuucaucuggccagugcuguggguugucccaagaaagcagaaagcagagcuuguccuguuuccuuccucucacaucagggagcaauguguuugggccucagacaguuugcauauaaaagauugaggcucucuguuaggagauaagccagauacaaaaauauauuucacagagagaaaauaauuuaaauaauugcauauuuuaaauuacacuucuuagagucuuuuaaaaacuuguauugagauuaugaaaagucagcuuuacccuuauugaaacauauuaggaaaaugaaaggaauauuaucuucauucacaaugggagagaaccuuguagcucccacagaaguuacuuguugguucucagagcacuugaguagcagaaaggcauguguuuguggccagugaacaccucacagccucagacugucacuagcaccuccagggcucagcucccucauuucagaaggguuggcuagguaacuaagacugcucugcaguaggacucggcgggcgaguuaaagugccuacuaaauaguaaucccacugugcuucuguguuacugcuggugcugaauaucaugaauggaauugauucucucucuguguguguguguguguuucaaaaaacaauuccagaaaagcuguggguaguauggauuaugaaauguuguacuaucacuuaagacccaugugguauagcuggacaggaccacuuuucuagugauguauccuggcaggaugugaauuuaucagcaaguugcuguuacucagucuauaacccagcccuuuagauugauggucuucauagcaggugacuaaagcacuugaggagaaugaaucaaggacaguuggguuuuugcuuuggguuuagaggcaagcugggaugguuucucugugagaggacugaauccauaaacuagucuuuccauguuucauuuaggcuguuuccaaauuccacuguuggugacaguggagucccagcaccaccuucuuucccaaugcgucggaugcgagaaucuguuucccggaugccugcuagguaauguuguacuuugaacucuuuuagaaaguuacaguggguuggguggguuggcagccugaauacaaagaagucccucuucauguccugcuuuguggagcaccaagugggaucuuucucucuguggucccagcguacuuauauucuggaaagugauuuugacugcaggucuuucuguuacaaugcaacucucagucucacauuacacuuauaaaaagcuugagguucugccuucuuccagacguggugaauuaggugucuguggaaaggcucccccaagugacgguagcaacuaagaagaaaaucagaccuuaacuuguaaauguuuaucccagccuuaaaauccagguaguuggcgauagaucugcuaugcucugaguuugccuuuaacuugucugugcuguuuucugguuuuaaaacuugaguuuacaucuuggucagugacacauaaguauuuagaacccaagauaaaaaucugcauuuuugucuaaaaugucugauagcuaaucagcuaccacuuaaugaccccuauagaauuaguuaaaggcagcauuuuagaacaaggaauuuguacugauaccuguguuuaugccugacuugaauaaauccuuuuugguaauuuaaaaaccacauuugagcaaaaaauaacuugccuugaggauaagaaacuagacuuugagaaccuaaauguagaauuccuaguacaagguggcauuucagugagggaacagccaggccuguucaggguggugugggaauaggcagaacauuaucccuuagaaaagcuggucuuuaucccuugaauguauaugagugugaccugaacaaaccuuaaauuucaucuacauaacaaauaugcucuccguugguuuuuggaguugggguggaaucuagggccucaccuaggcuaugcuggugacaugccauggagucauaccuuuagucacaggaguuacugguuucaggauguggggcucagacccaggagcuuauccgggcuggguaaaccuccuguugcugagcugcagcugccucagucuauccuugauaaugugugucccuaggcugaaacagucuccucauaggucagugucccagauguucuaacaguagaacacauacuuugcugugugcuggcuacagggaaagauuuuuaguuuuucuucaaauuaaacugggcagauuccaguuaggugguacuuauagcaaauacugaucuauucuuaaagauguuguaaaacucugaaguauucuggacagugauuuauuaccgaggagaaaauguguaauggacucuccuuuucagagggauggcaagcacaucuguuuuucauuuucaaaacuuugcaugaaaaggaacacagaagaguuuuuaaauagugcauauugagagagugaaauauugugucaagaguuguaugggucagguuugcccuaagugucuuaaugagcuaagcaguugaaaagacuuugccaauguggaggccugagugccaaucaugggacuuuuuuucuccuccgugcccaguucccagcacagauacucuacaccccaugccuucacuuucaacaccuccagcccuuccucagaagguucccugucccagaggcagaggucaacguccacucccaauguccacauggucagcaccacccugcauguggacagcaggaugauugagguaauagggccccuuggggguggugaugagcagcaguaguuaauauugggaagcagagaauguggauuucaaagcugcucaggaguguugcaguacuuucucaggcccuuggacuuugaaauguucuuuuuaacucucuuaauguguauagacuggcuuaauaacuaggccagugugucauuccaguaggaaacagaacuccucucuagccacugugcucugugucccagcuuuggaugugauuucuuugggcugguacagauacugcagagcagugagggcuguagugugaagaccucagaugcucuagagacuuguaaaguaggagcucugggaucugcugugcauugaggcaaaugugucagugccagucaguguuugcaaacugccuuucuuuucuugaauguucuguuccuuugguuugcuuucuagcucaucuuuaaagucaacugaauacccuucaaaugcuuccuuuguucuuuauucuucuuuauuucucauugcuuuggacuagaguaacagccugaaugcuucucccagggcgugcuccagacgauuuugucugaggggaagaguagguauuuucuucaugccuuugcuuucuuggguuuaacaggagagacuauugagacaacuauacauucauuuauacuucuagccagacuuguugccauaauuuuuuuuuuuuccuuuucuagaguucugaguuaaacaaacccucuggguuaccacugauagguaaauuucucaagguaaauucaggaagacaaggggauugaaauaaguuuuaaaaacucaguucucucaaaaaguggacugauauagugacacagcaucuguacugaguucagacauuagaaaccaaaacaguuaauccaucuaaguuaauaugacuuagaaagguuuaucaggaagucuggcauacuagcacaugacuggagucccagcacucuggaggacuguauucaagaccagccugggauacauggucaaauaaaaauaaaauaaaaaagacucaaaaucaaauaaaaaagacucaagagacguggccaaguaacugcuuucuccacacuaugaacugaccuuuguaaaaccuuguuccuugccgggcgugguggcacacgccuuuaaucccagcacucgggaggcagaggcaggcggauuucugaguucgaggccagccuggucuacagagugaguuccaggccagucagcgcuauacagagaaacccugucucgaaaaaaccaaaaaaaaaaaaaaaaaaaaaaaccuuguuccuugacaccugugaugucagaugcaguuucgcucuggcaguacaucacuuuuaaccacuuggccuacccuguguaaucuacaggcuuauuaguccuaguaauauaaucauaaaguagcuauuuucuucccauguccagcuuguuccuguuuaaacuguucguacauucaaagugaacauccuucaggucuaacaugagcagcacagcauugauccuguuugugccucagaagacaauuuuguuugugggucccccgccuuuugggggugguauuguguuuuuugagacagggucucucuauaguucuaacuguccugggacucacuuuguagaccaagguagccucuaacacucagagaucugccugccucugccucucaagugcuaggcuuaaaggcgugcacuuuuuucuuuuugucuuuaauaacacgugauucacucagcauuuuggacuguauguuguuguuugccuuaacaccagucauguucuucuaaacuaauacuuaagaguauuuaaauuuuuuuccugggauaaugugauccaauuauaguaauuacuaacaaauaaaauaaugggcagaggaaggaaaaaguaggagacauuaaaaacuauccugcuguacuguggaccagaaaucuaaucaaugaaaauaacagaagagauugggugagugaccggcauuucucccacuuggcugccuugguguucuacuuaaaacuauacaggcgccacuuuucuaccuuucccacacagacacacaucaucagaccuaguuugaguuguagagugaagaucuauauuucaugugugugcaggcauguagaggcuagagacugaggucacgugucuuccucaauugcccuuccaucuguguuuugaaauagggucucauugaacccggagcuuuugguuaggcuaggcuggguagccagugagccuccaggauccuccugucaccaucuaugguauauggaucauaggcaugugccaccacagggggauuaaacucugggcuucuugcuuacauggcaagcccuucagcaaccaaaucuucuccccgguccuacggaccuggauucuuacuuaucucuguggaugguuuacauauggcuugggacucaggcuuuacucuaugcuguuaagauaccuggacaggguggcugaaacuguaugugugugugugagagagagggggggggugggagagagagagagagagagagagagagagagagagagagagggagggaggaagagugugugugugugugugugugugugugugagagagagagaaagagagagagagagaggggaagagugugugugugugagagagagagagagagugugaaggagagugugagggagagggcagagcuugguuugugguucuuuuacuuuuguaaagauaucuuuggaagcuaaucaugguggcacauaucuguaaucauagcacuacaaggcuguggcaggagaauggcaaguucaaagccagccugggcuacacagugagacccuauauuuaaaaaacaaccagccagccaaccaaccaaaaucaugucuggagugauggcccagcaguuaagagcacuuuuuuuuguagaggacccuaguucaggucccagcaucuacauacaagcuaacuacuguuuauaacuucaguucuugagaauguaguauccucuucuggccuccagggcacuacacaaauguggugcacacacauauauacaggcaaaacacccuuacauauaaaaugaaaaauaagccuuaaaauauugagugggaacauccuaguaauaguguuguagagcaaauaucuuguuugcugugguuauacaaagaaaaguaacagaugacuuucuagaaaaacauuuucugaaguuaugagggucaagugguuuuauauuauugccuauaaauucuacccucgaggaagaauuuuaaaauguagaguuuagaacucucucauggaaggggagggcuguauggagagcugagcaguuaagagugcuuguugcucuuguagggcaugaguucaggcccagguacccaugugaggaggcacacaucuguccguaacuccagcuucaggcaugaguucaggcccagguacccauguggggaggcacacaacuguccguaacuucagaggucucacagugucuuuugacuucuuugggcaccuacauuuuccuguguguggugcaccacaaacaaaucaaagauaaaaucuugaaaaaaauguccuguugagguaggucucuaugauuugaauuauucuuugaaacagugucuaguagaguuggcuugucacaaaggagaauguagccugcuugagaacaucacuaagguuuaaaguagugucucagugcuaaugaagcugagaucaauaugugaagucuauauguuucuaccaccuacuguucuaugaaccugacugagucuccccuucugucuauuugaauuuaaaaaauguaaacacaggauucaggcucuggaguucgucaucuuuccauuucccugugacuuaggccucaagcagugcuuaccugugucaaacccaacuuuaggucucuauuuguccuuauuccuaaugaaguaaaaaugaggcugucaguggaucucugucuccgguuaagucucaguagagcagggucccgagucuuuggaggagauccccacugauaacuuugccagcuuuuacugaaggcuuguuuguuucuguugcuuuuuucugagaaauauugugguuaccaugaaaagguuacacucacuuaauguaauauuuaauagaaaucaaucuuggaaaaauuugcuuuuaacauuagguaaacuaggaauuuagaguauggaaguauacuuucuauuuuagugaguuaacaauuguuuuguuccuacaaccuuuccccugcaagagaaagcuguuucuagcuugucugaucaacuuuuguucuuuguuucaggaugcaauucgaagucacagugaaucagguacuuuacuuagugaucaguaaugggcuuuuuucucucuaugcugugaucuucuguuggcuuaucuacgugcggauucuguuugucuugucuauuaagccucaccuucagcccuguccagcagcccaaacaaccugaguccaacaggcuggucacagcccaaaaccccugugccagcacaaagagagcgggcaccaggaucugggacccaggaaaaaaacaaaauugugaguaugacuaguaauacuuuauugagucacucagggaucaaucaagauaaacucuugcaaauuaaauauuugggggugggaaccuaguaaaauauauuacagggaaaugaaugccagugcucccuggcaccuucguauccuauacguugccauucggcuacagcucaguaaacuggcaccucaaagacagaaaguguagcugcagugacagugccaucuuuaaaggaagcaggaacagauggggcuaggaugagccucucuuugaaagcauggcuuaugaaugaucuccacuuguuucagaggccucgugggcagagagacucgaguuauuacugggaaauagaagccagugaggugaugcugucuacucggaucgggucagguuccuuuggcacuguguacaagggcaaguggcauggugaguuuggggccugguuccagcugcagggcccuggugguuagguuccagcagagaagguuucuugguuuaugguggccuucuggauggguucuugaucauaccuggcaaucaaaucaauuuugaaauuucacagcauuuuaaccuuacguuauuuuaauugguauaauaaaauccccguggugcuuagaaaccaguaaacaaguauuagcccuggagugaaauauuaguggugcucauggaacaugcuucuucaugagcagaugucugcugcuuugggugaaguguacucuugacaccaacagcuggaagggaccuuauaacagguacaaggaggagcugucugcuccugaucaucuuagugcaggaaaacuggacacuuccugaccagugucucucuuugggccccagauuuaauuguagcuaucucuuccugugccagggggaauacuugaucucucagaaggaagauuugagcuuaaacucuguaguuguagcuugaaucauuuggcaacauacuuaaccauuuccauaccagguuuuuaacaccuggauuuaggauguuagcaguaaaaguagggguuucuuguaugugcuuauaaaguuucuugauguugcaccccccaguucagacauggugcugauaaccuuuauagauaauggggcagagauggagacaaguucugagcauaaagugugcagacauccaaauuccucuggaaacaacagcaucuacuucucucggugcacaucauuauauggguuuuugcuuugccugagucgucguaugaacaguugauuucuuaacagcauagaucagagaguugguuagugacucuuagagugacugagaacuguuaaguaaugcccugcuggccugucucuuggucugcagaggaaugcugucacugcagugggccgugaacagagccuguucuugaaggguugcuuaguaucaccuccagccucccuccugcuaucauagcccgccuguaaguuuugccuuugcaggcaccuggcgaccaaccauuuuccuggccucaccacuuaaguugaccugacccccucacccaucucucaccucgaccccaagcccucccaguuuguuugccauuguaacuccaagccugcccucaccugggcuauugcaccaaauucuucucuagcucuucuguucuacgagugcucaguuacauguccacaagacuccuuacuuuuguuucugaugcagucuagacuauccuuucuaauauuccuccuagugcuuacaguccacuaccuccauacacuccucacuucucaguagucuuugagcccagcuacuaucuugucucagacuucacagccgugcagcaaucuuccuuccuuggccagugcagccccuggggcacacaugguuucuggccacugugcuggacugguggcuucagcacugcuucucuuucacucagaugagcugcauucucuccagcagccugugccuuccuucggugcugggacaugucagcugucaggucagguacagaugauaaucuggagcucacaggggucaagacagggaccuccugggaacccugccuuuaccauuguucacaacugacucagacuuugaucauugcugccauggguaaccgacugguuuuuuuagacaagguguugguauguagccuaggcuggcccccgccucuguuucuagccagccuuaugaaaauuuaaaguccuugcagggaagugguggcauacuugggaggcagagaugaguucucugagaguucaaggucagccugguuuaggguucuaggacuacaggaugaaacauugucucaacgccuuucccuaaccuuguccccaaacugggaucuuuacaagguuccaaguuuauuauuguuaauacuucuauauaaaacauauuugaaugagacuucuaacuaucucugaaagcaagcugacuccuggguguuucugaggauauagagagguugcuuggauugcugccacuacuaaaagacaggauugugggucuacuuaccucccuguucuaguucucuauuuagaagauaggaccucuauuucuacuuccucucugcagaauaaguucaguaguuguacguacacgcugcaacgcagcaagguuucaguaucccuauugcucccacugguaaagaaccccuuucaacuugagaagggccugccuccucaucacuuuguauuuggugggcuacccauggccucggcacuacuuuuaucuucacaggguaaagcuguagagcuagcucauaugaccuaccuugacgcucaaguggauaugcgcuuguugaaggccuccauggguaugaguagcauugaagcgucucacccacuugauguauauuaguuggcauauuuguucuaccugcauauauguucuuugaaaagugacucccuaucuuccuuagaauuaggguuuuuugaaaagcugggagguggcuuaguugguaaaaagagcuuuccauccaaacaugaggaucugaauucaagccccagcaguuacauaaacauucagcugugguuguacugacuugcauucucaguacuggggagguagaaaggggcucacugguuaacccuagucaaugaguccugggucccagugagaaccugccucaaacaaaacaaaagaaaacaagguaagaugcacauagauccuaagguauuugagaaacaaagacuauauaacaaguaugacuacaaauuaauuugcaggagauguugcaguaaagauccuaaaggugguugacccaacuccagagcaacuucaggccuucaggaacgagguggcuguuuugcggugagccuagucccuggacagcaggguuagcuagggccaggcugugcaggucagcaccugcuguggguuuuaagguuuuaagggacgguccuccuccaguguauauaugugcuggaagccagaagagcccuuuucauggacacaccccuucucuguacagcucuaugggguuugguuugugguagugagauuguuuugaaccuuuauuucuuuuuauagcuaauagcaucuuuuauagcuaaucugcuuugcucuggagcucaaacccucaguguagucacggaaucacucuuagauuaguagggaugagcuggacagacugugcaaagugcauucucuguaagcaaggcuagcuagcguggagguggacaaaggauggucucacagcugugcuccccuccuccccuuagcaaaacacggcauguuaacauccugcuguucaugggguacaugacaaaggacaaccuggcgauugugacucaguggugugaaggcagcagucucuacaaacaccugcauguccaggagaccaaauuccagauguuccagcuaauugacauugcccgacagacagcucagggaauggaguaaguacacgguuuggugaguccuuguggcuugaacccuugagcugcuuuugugggacuggaucgaguggcucuuugacagcagauauucauggaugggaaguccggaguucccguuucucaucagccugaccguccacucagccauggccuacagggagauacccuuuccucaccggcacuuuucucaauuacaauucaaaaaauuuuuuuaaaauuauguauauuuauguggaucuuuguguagguaugagugccaguauucaggagucccccuggggcuggaaucaguuguaagcugccugacacccaaacugucucuuuugauuauccauuuucuuucaaaggucaucucuagggucucugcucccaugguguggagugaccaggugaccaccaggcagugcucuuuagcuuuguuucccaagugcccuuauggugagggugcagagcuccuuagugcuuacagccaggugacuguaguugguguguuacaaaauaagugcuucguucugucuuaaagucaugcagaagccagauagguggugcauaucuuuaaucccagcauucaagaggcaaguugcaucucugaguuuaaggccaguauagucuauagagcaaguucuaggacaggcaggacuaaauagaaaccuugucucgaaaaacuaaagaacaaaaaaauucauacagaacucuaaaucauaagcagcacagguacaauucaaauaccauacaaauuauuuuggaaguguauggcuugggggcuuuucuguauccuauuacuacauucuguguucuuaccgcccagaaaaaaauccagcucacagccauccccggccucugacaaucugccuucccacuucuggguuugucuuggauaggcagaaugugaggugaaaugccuggcuugguuugcagagcaaauccaaguuucaauaugcagagcacagugcuacccaccaguuagcugaagggcagugaggugguuaacugagugauuuuucuccuucacagcuauuugcaugcaaagaacaucauccacagagacaugaaauccaacaguauccuuugguauugaguucucagcuuaaggacccaaaagggccuuuuugcacacaugguucauggugccagaauggggagaaggggacuuuuaaaggaaaauagaaauauaguugagaagccaaacauggugaucaugagaguuccuuaagguuuuauuauuauuuuuuuuaaccaacagugaucuggaaauaauuccuucugaggcgauacacacuugaaauagacuugaacucagccugguuagauuauccagaauauagcuugagaagguuauugcaucuauuucuauugagccuauggaagguguaagccugcauacagaugggaaaguaucugaugcauguaucuaauaccaacaagucauaagugauugcugccuccugcucacuuuucagaccagcauaaugucagccauauaguagaccaaugugauauuuuguagaagagacaugaacaagaucccuucaaacuaaguuaugacacaaggcuggagaguuaaagguuuacuguugaucuuucuaaucaaaagcaauugcuucuggugguccuuauggacagauaccaaagaaaaaggcauuugcuaggucaguagcuacacaucguauaucaggaaguaugcuaauugcucaaguaaggacaccacaucugguauagccugucacuuuuuacaguccaucugucuucuguacuggccaugaaucaccaccccugcaucuuucaagucuuugaugguagcacugauugcugcaauucugccagggaugugacacuuuugguucccaucccuggcagagacccugcuaaaggcuuccauuuagcuuuucccaggggaaacaguuugaaggcccacuguaacuauugugagucagacuucaaccaaaauuccacuaaucaccugaccuccuauuuuuaacucaaaggacacaauauuucuuaaggucuccuggaauuagcaucuuagaaccaguaucccagaauuccagaaauuucaaaauggcuacuuucuguuaaauguacagaagucagccuagaggccacuguuagaaauagcaucuccuuaccaacugcaccuuucaugcuguaagauggcacauggcagggugguuaaacucagcuguucugcauggccaaugagcuaugcuuauucgguggccaugaccuccuuucuugaggucauucuuuuucggcagcuaagcacugggccaagauuuaaggcuugaauuccaauaaaucagcaggucacaaaucagaccaaaauugccuguuaccuagcaguaagcugacagaagucacaauguagaccaguugggugguaaaccugaguaccaaauguaggcagaggggauaagcaguguggggcccuguaauugagugugcgcaugccaucguucccugucuccugaaagauuuaguagugaagugaaggaggccagaagcacuguuauaaacaguauaaacugucagucuccuuaacaagcaucgagauauauuucuccaugaaggccucacggugaaaauuggagauuuugguuuggcaacagugaagucacgcuggagugguucucagcagguugaacagcccacuggcucugugcuguggauggugaggaagcuggccccacacaacaugauggaauuacugggccagaguagggugcaaaauuugacagcauuucugcacagccaugggggucugguugaucuguggugucaguuagcuuaaggcaaaaccgcauauccuggcaaagcaacagaggccagcgccugugggguuuugugggaggagcuacccugggcuaaggacuugaacuuccuuccugacuaguuaaaauagccugguuccucaaugucucuggaggucauucccuagggauuaacacacuucauccuuacaggccccagaaguaauccggaugcaggaugacaacccguucagcuuccaguccgacguguacucguacggcaucgugcuguacgagcugauggcuggggagcuucccuacgcccacaucaacaaccgagaccaggugaucugcauggccgggcgacacagugaggggcuacuuaguccugggacucuccuucacagacuccuuuguucaacuguuucuucuuuagaucaucuucaugguaggccguggguaugcauccccugaucucagcaggcucuacaagaacugccccaaggcaaugaagagguugguggcugacugugugaagaaagucaaagaagagagaccuuuguuuccccagguuagagagcucaguugaaauauaacauucuaaggauguaaaugugggccaggauugggucgguggagagaggaccuccacaagcucuugguaugguuggggagauaccaaguuuccaacuaaugagaccacguggggccuuguuucagauccugucuuccaucgagcugcuucagcacucucugccgaaaaucaacaggagcgccucugagccuucccugcaucgggcagcucacacugaggacaucaaugcuugcacgcugacuacauccccaaggcuaccagucuucuagcugaugauguagcuguucuuaggccaccaggggacgaagaagagucagcaggcaccacuuucuguuuccuugggggcagaaugcauguuuuuggaaaagcugcugcugcuaaggaccuagacuacucacagggccuuaacuucauauugccuucuuuucuaccccuccugcccuggaaauggaagcuguccaccaagaaagccugcucagcuccagagguauacaagucagcugaguauuuguagggcaaguggccuuggagaagguagggcacuccggcugcugcagggacaugcaauugggaacuuggcuccuugagccuauauggacaguggugcagugccaguuuugcacauggaguccuggccaccugggggagccugcuuugguacuacagaacuuuguggacaaacugugucuaagguguccuguguggauggcuuuccaagcgcggugcuccaccuuuggcagccucccacgugcugaaucugucuuccaggagcugccccuauggggugggccgcggcccaacccuaucuguagccacauccuugucuguaagaaagccaggaauacagguuuucuuaaugauuuuggguuuuaauuuuguuuuuauugagccaauacaguugguuccuuauguuauuuuaauaaaauaaauuaaauuuagguuuaauggcuacugacuccuuca

SEQ ID NO: 12118 - RNA, 25341 nt, Mus musculus
uuuaacguuuuuuuucuuuucuguuuuuuuuuuuguuuuuuuuuuuuuuguuuuuugugguuuuuuuuugucaaagauaggcaccuguugaaacugaguggcuacuguaagucaguaaggcacuuuucccccacaagugggcugcaggaaaaggaacggaucugcagcuccaucaaggguguguauguauugauggcuucguaaaaccagagccaagaacgggucucacagcccagccacguuuaaaaucggaguagcgcauguuccggcucgaggacucuuuugugcuguugaaaauccagaaacaucaaaagccacaugguauauggaagcuauaacaccuccuggggcuucccuacacuauuucguacaaauagauaagcaugccgcagcuguugaccaccaccuggagucugcacugagagaagccuaugugugcggugugcaccuauggagggcuugucggcuuaaggggacuucacugucucaguauuaauuccccuuuuuaaagcuauucccaagguuggacugucuaagguaagcaagggggaguccuuugggcuuagaggucagcuggcuuacuuagacuucugauugcuaccuccaguucccacaccacuguccaggacacagggacaagugugguccucccagcccuguccucauggagacaaagcuccucugccuucuuugugaaagccacccugucuuagccuguugcuccuauaauucccaaggcacagucugguggguccccaaagagcuagacuauaggaaagcucuuaagcucccucugaggggucacuuacccugcuagcaacaagaugggauccaggggugcuacauguacccccagccuggcugcuagagaggagucccgugucaguaggcaugcaccuuaaagcuagcaaccuauaugacgggcucugcuuucccgugguguccuggggacaguucaaaccaaagcagccucuacaagcugucccaucuagaagcagcucaccacucacaggcugccugguucuuaggaaccauuaugaaucuccuuaugcuuagcauauuauuuuuggcauacuaggguuucuuuccccuaggauuuggucaaaacagggaaggaucaaaauuuggcaggcugggggaacgacuuagcccccacugauggagaaaaaaaacaagaacaaacaaaaacaaacaacaaugacaaauuagaaacaaagaagagaucauuagcaaggcagaaaaagaccagaaucugcaaccccuucuguaggauacgaaggggcuuggggagagcaagcugaaauccuuggggucguuuauaccccucugagacagaaauacuaccaaggagacccacaucuaagcagaagguauuggucaccaaggaauccaggcucccuuccuuuguguaagugaggagcaggcagaauggccacucuacaggacucguuccacuaggcuccaaggaaggcaaacaggaagagugucuuagguuccagguaagagggauggaggggcagauaguaaccugccucuccccuugugugucagcuuccuucauucaauguuucaguuaagcucaaaggccacucaucagguacccaaguugcccaagaacucaagggagugugucugucaaguucuguggggucccuuaaggaccagaagagugugcugugcagugcgugagcucuggauaaacacuggcuagcugcaggcugcucccguuuucucucucaaacuucccaaaccaucacccaccguccuaccacaaagccccuagaauuuagggucucgcuaacucaccaagucccaauccuuccuaaauacacccgagaccacagaaacagccucucccuucuuucaacuugcauuccagacucauucaacuugggccuccuaccuugccccacucaacgggauccaaacccugaagccauucaaugcuacacacagacaaccuggccacgcacagcacuugccugucacuguagacugcagaggacaagagaaggagaaaggaauaucauccacgugugcuguagacucagcaccaaccagacucaguccuaggaagacuucggaggccauccgaaguugggguauagaugccaagaaggaaacuggucaauguucaugaugaagggaccccaugaagaggaaaguccugugucugaaugggcuacaagauggagggagggucuccuaacugucugccagaauucuucauugcagacccuggugcacgcaugcaaaucaggcugaccuaguccacugucuguguuugaugaguaucugccuuggguagaggagcccuucgucacugucuucuaucauaagaagggagccugcgucaaaggggagccuggcaaucuucaagacagagaagaccccuggccugagacucuggggucagguuucuccugcuuucuaucaaggaggauguccaguuccugucuucugccugcccugugccucgugccagcggccuuccaaacagauccgguauagcugugagguauuaggaaaacgaaaagaaguacauuguuaucacuauugguuuuguuuuguuuuguuuuuguccaguaaaccugagguaaagaauacucucuuugaagaauguggucagaggaggaaagaaaaccugguaaugaagaggcacggaagaaaaggaaccaaacggaaccaaacgcaacgcagcccaucgaugcuaccagaaggacagggacagaggaaaaggcuuuuccaguacagagaacucgucucucgaccaucuaccucgggacuugaaauuuaagcaguaaaauaauauauuauaacaauguuucuaaaauagcagcacaccgugaaacauuacagcuagguacuguuaaugugaaugggggugaacgaucuuagcuucuuagcagcgaaaaauaauaauaauaaacagaacaaaagaaaaaaugaaagauaagagacccuuagauguuucuccaucuucaacccucacacugugaaacaaggcagaaccuguguauaacucuucaaagcagcccuguucugaucuuuucucaaaaaaaaaaaaacaaagcagauauuuuaacaaauagcuucauaaccugucaauuauaauugugcaaaaaaaaaaaaacaaaaaaaaacaaaacaaaaccaaaccaacuguggcucccacuucuguuuacugacugucuccaagaagugggagaggggggucuucaaguacaaugaauacaacuuugcacuaaaauuacaaacaaacaaacaaacaaacaaaaaacggaaaagggaccaaaaugccacacccugauguucagccugugcaucagaaguaaccuuucuuuccauguccaaaggagaaaaacauagacggggauucaauccuucuaagccaucacaaugcuuuagaccucuguugacagguuuuccgaagaaugcugggaugaggauaucagcagagggcuuucucagcccuggcagggacaccagagcuggguaccagaacaucagacuccagaaaugaacaguaacuggacgagggucaggaaggggaggggcaaaggaggaaggcguauucaacaugauuugcauaaaccaucccauaucccaccccacccucccccaaaauuuucaaagugcuuuucuaauggaaugguuuauaacaaaguuaaacaguggaccagacaugcuaaucagcaccaaaaguuagggguaguuucuuuuuuucuuuuucuuaacaaggggauuaaagaucaccucacccucuucccuuacacaaggcagcuuuguuuuagauuccgucuauggucuccaucugcccccauuuagaugcguuuuggucauggcccauagcgaauucccuccaucagauaacaguaaaauacaucuacaaugaaccauguuuggaaguagaagcccaaauucaccaaacaugagacuuaggagccguucaccuguguccaacuggcaaaagacauaucccuuagguagcagcuacuuuagucagcaagaguaugcgacggagagacccggacgcucagucuugggaacacguggugaggcaucaaggcgcuucuuacauccaaaaugguucagucaugugguugggugguuuugcgcaaccuccccggcaugucccuucucguuucugauuccuccuuggguucacugcuuugcaaacuacucaugcgguccuggcacccacgguuccuugcaauucuacuaaagggggcauaugcacuaggucacaagcacaaaagacagucuccucuaauucguucccauguugcagguacgcacacucucuagcuagucugcggguucuccuguaagcaucucacuaugacuuuuacaucaucaaauaauaacgguucgaguguacagggauccccuuaugcaggacuuugaacaggcaccacaugcguuacaacuauacggccuuuuccucucacuucuaaaagaccuuuaaauaggaucuaggugggggcagauuuuguuuuuguuuuuuguuuuuuuuuuuucuuuuuugaaguuucauccuaaaaacacaaagaacaagacauaacuagagagagaaggggcuagcagaugacgaacacgccucucucuugccgcccgaauggcuuccucacaggucaacaucccgcacgucuguaggggugguggcuugguccggaucuuccacagacuuggauccggcguuaugcugcucuugacggaacugcugcaggcuguucagcagcagagcuucgauuugcuccuggcaggcuuugagacaauccuagaggagagagguccagaccggggcuauuagcacaugcaaaugcauagaacgccucucaaaggcagacgcgcgauccaacucacauccugauuuuccugugagguaagaauagaaauguucucaaaugccauggaaacuacucaguauacaaaguggggggccacagcaggcagcaucagcaccaucugggaacuagcuagcagccuaucccagaucaagcuggucagaaccagcgcaucagcggacgccuaaguguuuccuauuccaaacugcauugacuggaaggugauccagcuacaaaaagcccuugccugguuaucaagggaccagcuggaggucucucugucugggaaagguggcacagaaagucugguuccugcaagguguuacacuguaagucaagcaagcaaccguggaacggauagaagggcggugcuuaaacaucucugcauucuuuuaccacccuuggaccccuuucgcaaaaacacaaugcauacuguuuacaaaacucgggacacuugagcuuguccaauuugggaauaagcaagauuuugcaguguugccuuuauuagucuauauuugguagggaaaauccagagugagcugucccaggcagaagauuucuauuugcugggagacauggaaugugagggcaagucauggcugucacugggaugggacuaaggcucaggcuagaagguuggggggaggggagccccuagcagggauuuucacccuaguuucuccgucccaccucccugcacuaggaagcauccugugcguauagaaacggugcuaacucgaaucuccugguaucugcucacaguucaccauaaacuucccucuguuuauuuuucugcuuagaccucaccaccuaggaauugauauuuuuuuuccacaaacauaaaggcauuaucuuuauuuuccagagaccugaaaauaaaguuggcaauaacuacuaaggagcaaaaguuugcauccucuacccccgcccacccuacugcuccucauccccccccccccacaugacaccuccauuuuuauucuuucccaucucucaucugccccccaguucaaacuguagcuugaagaugaggcauggcagcagaucaagagcgaaggucauuggcugaaacguucuccugaaccugggaagggcgggaagcaggauggggaugucuggugcucacucggugcuggcagggcacagcuccauuugcaaaccccgguuucuccaaguauaaaaaugaagagcuaaguagcaaaucaauaaaugauugguguguguguguguguguguguguuuuaauggcuccaucuguccaggaaucugaaagaauccuuuggauuuugagacucauguuucucaggcuggcugaguaguugaaacuuuaaguacacaaacacgcccauccuauauuucugugaacaaagguauagaucaccaacuacuuaagacaaggaugugucgaagguuaauccuagagauagugugguccagcauugggggcgggggucaccgggucaccaggcuaauuuuaacaggaccaaguaaaggacucaugugcccaggcucuaacaucucucauccugauccuugggaccugccacccucauuagcaauuaaaaacucagguccugacagcuucucauuuguuugccauguuuccugcuaggccaaucuggcagcauuuggugauguguaaauagcuuuuuccuggaaggcagagagaaugagugggaacaccccaauaccagagacagcaaccauauccaugccuccaaucauguaccuggccucagaaaucaaauccuaccugaggccuggaagcuucugguauuuuacaacaguaggauuuguagcugaugagggauccuucgugaggcugggucuaugugguggggcuugagaggagaacucggaaccacuccauuugaaaggaagcuggcugaggagaaggcuggaggauuaugccucugaagacagccugggcugcagagugagaccuucuauaaaugaugaggaaucuuuacggugugugugugugugugugggguuacuuggugaauauuuucugauguaauguacacgggagacucugcucuacaguaggaaguuuugugccucuuggccaaguccauacaacccuuuuuuuuuuuuuuuuuuaaacuaguccgcuaucuucugauucccggaaaagaucaucuggguuggcacaucuaccccgucaucacgacccuuguacaucucuauuguauuaaugaugccagauggucuucauaaaucagccugcagaaagcuuaagaacuuggcguuaggaucugcagugucccuacucuuccuacaguaagccuucccuucuagcugcccaagauuuuaaagggauaguugggagaaaccccuacagggaagacaagacaucuggcagucauuucuacugcacguucagagccaagagcucaagaugaugcaagcaugauguaaugguccagccaaggguaugcucaccaaguagucuaagcacuggaggaagauccaaagguuucauguaaacucuaugcucucccuucccaguguuaacugaaauucaaaucauuacugacuggaugaucccugaucuuugcucccucucauuuggagagaggaacaaggacugaugcaguuagccuacgaaacauggcuacagagucaucugccauucaccugggagacugcuaaacccaucaggucugcuuaacugcugucuaucagcuuccacuuccucauaaguggucaguuauuagcucuaccuucaacaagggucccucaguccuggcucggccagguagaaauccucuaucugcaggaaguguagaacauauuccuuccugaggguggagagaccuacaugguauuccuccaacauccaucaaucaucaaucaaucaaucaaucaaucauccaccgaucaaucauccaucaaucaaucccaacaguuacaaccgccccagcuuugcaggagccccucuuggagccauagugcaaauguacuuucuguacuuuucugugagcuggcaaaaagcaaggaagaaaacaccacugcaggggagucugaacauggguuuguguaagcaugccucuguguguguguguguguguguguguguguguaggggugaugauaacaguuugcaggggagucugaacauggguuugugcaagcaugccuguguguguguguguguguguguguguguaggggugaugauaacaguuucccugaucaaaagaugcuacauccaugugacaagcaggaacuccaggaccucagcuuuguggcagccuccgaaagcagcaggcauuguguuaagaugccccaaauuaagcugauuaaaaggaaagccauaaugcuagucugucagcccggacaggugguacuccacugcgcuggaggucgggcaccccuccaacuccucugaugacgggucccucccuguacugcccccccccccccauccucagagcccugacagcagcggcugugaucucuggcucguuacucaggccccccgacuuccuccacuugcuggcucgagcucucugccccgcacccuccacugccuccaugaauggacccacggaacuccaaccauuagccccugguguaacugcauccacccauugucaguacacacgcacugcacucaacagugggacaaagagcugaaugagcugcagacccgccgccaacucaggcagagacaacuuaggaaacuaucucauucuugcuuucuucgcgggcugcuuggcucguuuccuugcauacagaaugagguggacaagaaaugagggagggagggagggagggagggaggcagcccccagcucuacccgccuccccacccccaggcaugcuuuccagaauuccuaccuccccgaagccccccuuaagcacacugaaggugguauuagucagaggcacuuugagaauacaaguuucaagccaaggggggcgggggacagaagagaugauggggacccccucuccccagaaaaguuuggguccaaagugagcaaugcuuacuuaaguuauuuguuuuguaauuacucgcugagaaguuguaucauaaaaugccaagaugacccuaagggaagaauauucuagaaucuauucuaggcaguucuggagaacacggcaagggguccuguuauaaccgaggcagaacugacaguauuacuagagccucuguuuguucuauuauauaucuucuagaaacuuccucaaaucuuuauagcauggacgccucaguucaacuuuuuuuuucccugucuugaacuauuggggauugaaccuugcacgcugagccucauaccagcucuacucuauauugacuuaagugugugacugacagugaaauuaagagguugcuccaagauaaaucuucuguuuaaguuuguacauguagauagacagguagauacagagagaugauaaaucuuuccuaagguccugaaugaaugagaggcacauuugaaagcccugucugccuuucguccuuccauccuucccucccuugcuccaagccuuaguuucuaaugacugcuggaggcuugagauaaaaagccaaguucaagguaggucuuauucaagaggcucuacagucaagugaacagugagguaaacucugaaccacagcaagacuacacuguggaggggauggaaagggaacaggauucugugggggccugggauggucaagcccugcucucaaacuuccucuuggcaacagaagucuggguauguagaaguucccugagagccaagcaggccucccuggcuagugucuguuuuuaguaacucuuaacuuguggcuggaagggaaaaggaccuaaaauacacuguccucugagacuccccucugucccuguaagacugucaggcuucucgcucagacuucucuucggaauggagcuagucaauugauuuuggcaaccauauggaaaacaaagcccguuucucagagccgcgugggucccugcagccccagcuaucagcugccagugagcugggagaugcugucuagcuauggcuggggaguccaggggaccaacuuucaaccuugaccucgggccagccgugagaguagaacucggggcggggggggggggggugggcacucaggaauggcagucagcuaucaguggcuccuggcuucuauuuggauugguuuaacuucuccacaugacagagcaacacacuaacuggcauuucacagggaugaucuguaugagugugguauauuuauaugaauaaaauaucauggcauaggggcuggagagaugcuuuagaaguuaagagcacugguugcucuuccaggaggcgugaguucaauucccagcaaccacgugguggcucauaacuaucuggaacaggaucuggugccuucuucuggccuguaggcaugcauguaggcagaacacuguacauauaaauaaauuaaaaaaaagauacuauggcauaaaauugaucauuuuuggugcauuuuggugcaauguacauucauacuguauguuauggcuaggauguuccacuucccuaccuaccuguuuuccuuccuuccuuccuuucuuccuuccugccuuccuuccaaccuuuugaccaacuuuccuuccguuuuuuguuucuaugaauuugaccucucuagcugcuucaucuaugacuucucuuuugcgucuggcuuauuucacuuagcacaaugucuucaagcuuaaccgugcacuuagugucuauaggaugacauuucuuuuggaaggcuuucugacaucccaucauguggccauaccacauuuuguuucucuuagcccaaagacauauuuugcaauuuuuuuacucugcucaaauuuugcauuaggcauccuaaguucauuugcagacaugcccugccucucuuaaagugccucacgcuagcauuugugaggacccccgccccugcacacuuuucuuuuccuuauugaauuuuaauuaaucuguuuuuauguguauuggugcuuugucugcacguaugcgugcaccacaugugugagguacagaucacugggagcugccacguagguucugggaaucauacccaggugcuagaagagcagucggagcuuuuaaucacugaacuaucuccagcccuuacugucuucgugggcauugugugugucuguguguauauauguuuguauguauguguauauauguguguacguguguuucuacaugugucuuuuuguguuuuuauuagauauuuucauuucuuuuuuuaagauuuauuuauuauuauacauaaguacacuguagcugucuucagaugcaccagaagagggcaucagaucucauuaagggugguugugagccaccauguggucgcugggauuugaacucaggaccuuuggaagagcagucaguacucuuaccugcugagccaucucaccagcccagauauuuucuuuauuuacauuucaaauguuauccccuuuccuaguuuccccucugaaaaccccacaucccuucuccccuccccugcucaccaacacacccacucccgcuuccuggcccuggcaauccccuauacuggggcacagaaccuucacagcaucaugugugucuaugugugcgugugcauguucagaaguugaagaaaaguuuguuacuggcuaacauccuaucuaugaaguaauccuuagcaggacacauuaggaaaagugaagauuagggccuggguugagccccuacacacacacacacacacacacacacacacacacacacacguuggagagucagaaacacauucuccaugcugugcugcggguggagguggggagccucacaauccauguccuagaguccuggcuaaaaagcaugcuuuuuggcaccaacacuucaaauacucuguuuaaaacccgguucagagaaagaaagacccaugguuuagcucuaucaaggccuuuaaggccuucaccucucugagguagugucaaggccaaauacaggugaguugcuggauggcugugagcuuccugaguuuaaacagccugugcuuugcagacuucugcgaggcaccagccccaggccugugcauuacacggcgugacccuugaacccaguaaacucccucauggggcagucugaaugccccugcauauccagaggguaucuugugaaucuccccugcauucccaagccaagccucuccauggugaaacaccagaaccuaagagccaacaauacuccccucucugcuuagccuuuccacugaaugccuuuugcaaaauacaaagcucccaagagccacagagaugagcaaaguuuccaggcuggagacagagcucagaggcuuggguacuggcucugcuguuaccuguccugccucucugcugcauccuuucucugcugccuggggggggcggggggggcugcggggaggagggaugcagguaacugagcucugagaguuaucccagauagaacccucuucaacuguuacauccuagccagugaaaucaggaccuugugcgauccugguccaucucaaaaccucuguguuuaagaucucugaauucuggcagccagcagcagccucggggccauccacacagaauggaaaaagacuaaagcuaauaauaguucucgaauuucuacugcacucgauccuugugugcuuugccauccaccaaaaacuuugaguuaaaagaaagcccgagacaggauggcaagaaggcugacuggcagagauaucacucacaaggccaccucucaaaucugcucccucugucacagcuuuagcuguccccucuuugugcauucccaccucauuggggagugaguagaccuggacucucuccauggcagagcagaggccugacaacgugaacauaaauggacaugaacccuacacugcagaggaaaaucaguugacugcccacccccccccccaucagcuugcugagauucugucuguauuuuaagguacaugcacgcuuucaaacccauaagaggaagcaggcagucuuugugcacaccuguaaucccagcuauagggaagcggaggcaggaggaucaugaauucaaggcaucuuugugagauugucucucaauaaaauuuagagaaggagggcuagagauuaaaagcacugauuaagagcacucccugagguccugaguucaaaucccagcaaccacaugguggcucaccaccaucugugaugggaacagaugcccucuucuggugcaucugaagauagugacaguguacucacagacauaagauaaauaaaucuaaaaacaaaacaaaacaaacccuuaagggcugaugauguaacucaaugguacagugguugccugggauaccgagaacccaaccccuaguaacacacacacacacacacacacacacacacacacacaccucgagggaaggcaucaaucugcuggaguuugaccuuuaaagacaagauaccaagaaaacaguaacgcaaacaaaaagacucugagccaccaucauaaaccaaccauccuuccuggaacuugaggagagacaucggguuucagccaaggggacucagccaaaagagcugguaccuaccacaucagugugggugaucuuggccagcagcucugucagggcaucacacgugaguguguucacuucaucauccugcugaagcccacagauggcugcucccacgcuuccaguugcaaucaucgacggcggguacauggcaaacuugaagucugcaaagaaccagaaacuuaaagucaggcccagaaggaaaacggggcccagugcucgccagacagcugaugcgcagaagcuggaaggcgcagaccugcugccccuagaaccccuggauccacagccacugucucccuugacucccuccuuccacaggaagcccuuauugacuugucaacuguagauauucucaaagacacagaggcaggagagaaagggugccuaucugaguacacagcuagucauccggggcucugagucccagacacucugugcccagacaacuacucaagaagucaacacaugccuggaaccuuuuagugagaugauuaaaacauguuaucuuccauggcugaggaguugacucaguggcuagaguacuuauuccauccucagaggacccagguuugauuuucagcauucacaugaacugucuacaacuccgaucucaaggcaucugauaccuucuuccggucuccacagucaucaggcauaugguaugcauacauacgugcguuuugcauguuugugcauguaagcuaaauguagaagcagaauaaggugaguuggcuuaauucucuugagucucaacuuuuaacccuauuuuaaggaucuucagaacguuagggccgaggacagggcuuuucucaaacacuaaagacuaacaaauucuaaccacacuuguauuuuucuaagaguuaagacaggggauucaccuuaaauaguaggggcaaccugggaccuuaaacucauucaccgcugagugauucucuaaggggauccauggaacugugauccaugaacugcugguuucaaugcagaggagaauccugccaacugcuaacaugcaugcauugcgugugauaucuguuuaacacacaaagccaccauggagggugacguuguggauggaaugaaaccugggaacugucaaguugaucuugucuuugccccugccuuggggcucacagauuaaggaguugacagugucaccaucgaguggcagcugugaaaugggguccacuuuccagugaaugaucucuaguuguaccaagacaccaguaaguccaguggagacugaaggcagagcacagagggacacaugagucacacaucagcucagagugagaauccugggcugaacacggcacgcucagagcaaccuggacucuuccccucucuucgggcaaugcccucuugcagcagagcaucacagagaggcuuuuacaauggagagagagccaguaccucagcauuguaccucagcaucgugauucgacuguucuuagacaccccacaaaucagcgaaccacacacacuccccugcucaccugggcucaaucccaggagccagguaggccuggccaucugucugucuccuuggcuuuguuccuuccaccgcucaucacuuucacuuugagggccauauacuaugggauuucacccaacuccuucuggcugcugaccccugccuaugucuucucuauccuggcugaugugaugaagccaaccucccucccuggcucuugauguguuguaagucuccccgauauggguuacaggagacauucucuaucuaauaaacuuguuagcugcuguguguggcauucauaguguagaugagguagccagcccauggcccugggcccacagaggcccugggugagagcaccugucagugacagggcacugaagugcucucagaguucccccccucgugcuggggcaucagauagggaguucacccaacauuccugcagaacuuugaagucacacugcuaacaaaaccaacucaggguuagcauguggagccagaaggggugugcggcuugaccuggggugcaggugucaggccggggaggggguauuuaccucuucccuuauuaaguacugaaagaaguccuucuugggcagagucugacuggcucuuuauuccaugcuccaguacgcacaucuacuccuuccccaguggaaaaacaggugcucccaagaaguagcaguuucuuauggcuggguagccaguuuacuacccagcaguacaacccaguuuggugugucauacuuggcuucauuuacacucuauggguaucuuugaaaggaauuuuucugaccuacaaauuugcugggugguaguggcacucagggggcagaagcaggaagaucucagaguucaagaccagccuggucuacagagugaguuccaggacagccagggcuauacagagaaacccuaucuugaaaaacaacaucaaaaguacuaauuuaccuuuuuuuuuucccaccgugcuauccugaggauuaguuacaagagccgaugcuauuaacucacgcauagaaccuggcucaggguaaaccuuagaugccagacaucggucacccacgcucccaacccucacccugcuugccaccaguccacauugacucuggugugguucacccagagccuggaagcuccuaugaggagccucaggccugaccuucucccuccuggugggagcaggcaaaggacccaguacagaggaugggaaucuuggggugucagacgacugcucagugccacugcucacucacuaggggugcuggaccucugauuaaagagaccccaauccagucugugcuuagaguaacccucaacguuuucuccuacaugccacgaaaggaaacauaaaagggcuccugcccagaagccaaccacaugggcccuagauucaucugccaccuccucgugguaccaaauauccaggacuccacagaagcagcugggugucugggguggcucccgaaucaggagaagcacucuauaaccaccaacuuggaaucugcacuuuaaaaaaaaaaccaugagauuucacuggccaaacuguucuacacugaugggauuuaaaagugggaugcugugguccugcccaaugagcuuauuaauauggaguaaaagcaggagccaggaguagugcuaacaaaaggcucccggaggcugcuuuacucuuguuguccacuagggggagggagaucgguuugugauggaggaaacccaaccaacaagucugaugucucggcuucuuccucuccuucaaccuguggugaggugcagguuucaagaaccagacagacccggggugcucuuuggacagcaaaggacacccaugaugucacuuagcauccauacaucugacaccccccagaaggguucagcacaaccuauccuuuaugguuuaaggcaauaacuauuaauggcgauuuagcuugguggaagggagagaagagagcuguggcuggagaaaagcucucauucaucucagggccagaugaggcgcaagauagcgauaucaguuacagaacuucagcucgacaagcuacucuuccccccccccccccccgcccagcccuaugacugcccucuaggggcagcucagaggcacuguggaaaugugggucucauucuuccuuccuggccaccagagaggcuuggcuuacauucuagaacaagagucaaguccccagacuuuucagggccaccacugucuggaaaucaaaugaacaccuuuaagagaagacuggcuguacccuaggauuccuacccuaccuuaggguuacacagggaguuggguccagcagccacagcaauacucccaaugcaaaaagaggcaggugugggguaucuguaccaaguuuaaacucaauaccacugaaaucaugugcucaguaugguaagguugaugguagccuccugguuacccccaggggggagggggugcuuuuugcccuguuugcugaccuggagcccuccaggagagagaaguccacuucugccuucuccagagccacacguucugggcuggagcugcaguuacacucucaccccaccuaaaauuccuccaccacaaaggccagcggggagagcagcuccaggcaaucccagaccaccucucucucagaaaccacuguaggcuggaucggaaaggaggacacaccucuuugcccugccaccaaccuuaccccagaaccccauaaaggaagacugcuggucggccacacucuucccucccugggcccccggacugcccacgcucucuuccccuuucacacacacauacgcucagcacgcccccucggagggacugccagcucuuucacaauuggcuuuucccuuaaacuagcaacgucuccccagggcuggcuaccuaccaccucuucagggacugcccccuucccacgccuuugugaacccucaaaacccugggccauccucagguucaggguggaauauucaggacuggaguuaagagacugagggugugaggugauggggcacacaagagcacccucccaucuuugguccuugaguugcucugagccuacuauuauucaagggugcuagugaacuuggguucgcuagaucuuggccccagaagcucaacguccucaagagcagcaggccucuggguuuaggcuguccagccuacugccugucugcuggccccaacacuccccuccaccacccuuccacacccacauaccggcagggcuccaaagcuuauucacaugcaggaccccaaaugcagaccagaagagacaugggggcuuuguggucaggcccacccauuccagccccaggaggccugagcaccuccgccacuuucucaucaguccaugccucuggagcaguacuuggcacaugguucugaccccuucccacucuuuggcuaaagcuaggucaaggcccccaacaggcccaucuuucugacugccccuaccucccacugggccucugccccuagucacugaaucccaggcuccauauuugggccccaaaguuggcagcugccccaaggauuuggacaagauggccaagaaugggggaugggauccccaagaacacagaacggaccuguggucuauacagaauuggaggaauccauccaagcccgaguaauuccaccuaucgcccuacccccaccccagugcaagaucagggaggaagaagugaaagccuccccccaccccccaagaccuguuggucaaaagauaaggucaaagcaggacucuggccacuggcagcugggugaugugggaauuuaugaguccgggggguuagguguccuagggccagagagaaaaggcugacugacccuucccccacccugaaucacugcaagaggaaagagacaguuccuaggaaacaaaacugcaggucagugugggacugaccucuagagcccaggccagucagcaagagaagagcagggagcugaaagugcuguccaaagcguagcaaaggcuggggcuucuuauugucauccucuucccugacuguaggaacagcaggggacuccacgaaggagcugggacaccacaagugugcuacaaggccugaugcagggccccgagggcugcuggaccaacgcaaacugagugcgugcacgcacucgcgugugcgugacacacacacacacacacacacacacacacacacacacacacacaccccucuaaaacagggagauggaauccggcacgccagugagaggcuguauccauuuccgcauccaccuuaacuggagccauucucaacaucagugaacuuucgcaggaagcuccaggcuugcuuuucugugggucaguuucccugcccacuccaccaaggcuagggaaggauacauccaaaggccuguuuugcagaucccagaugaacuucagagaggucaaacagccugagcgaggucacucagugcuaaguaacgaagucugccugaccucugaacuuccaacaaagcacaggcccuauuguucauuauagcaucagcuauacaaacacauaauuaaauguuacaaggaauuaaaauguuacacuccaccuccccccacccccuaucacaucaacacauuucaacaacccuggaugaauugagcugcaccccacucaugaucaauucuuucuuuaccugcuaacccugaggagaugaacuuuugacacuuggcccccgaauucccaagguucuagggcagcgcuucucaaccucaaccuuccuaacgcugugacccguuaauacaguuccucauaccguggugacccccaaccauaaaaccauuccguugcuacuuuguaacuguaauuuugcuauuugugauuucuuauguagauauaugauaugcaggauaucugauaugcaggauaucugauacguaagcccugugggauguaucgacccacagguugagaaauguugugcuagggucuucuacccaggugugaagccaauaaagcuauguaucaaaaauccucuccagagcucagaauaaacggaucuuugcuuaaagguucacucccuugucaacaggaaacagcaagaaggcaauaaaccagcuccacggugaaggaauuccuucccccuuaucagggcgggcaccauguuuaucuugucguugguccuuuaaccuauauuugcccccaccuuccuuaaauucccuuuagggcuuaucuccaagccguccuuuuccucaaaagauuaaagauuuaaacacaaccagagagcaguaucuauaaucuucaaagggcacuuuagacaccauaaacaauauuuuagcaggcaccgacucccuuccccuuaccauacuugcccucauaaagaacuuacgagugaagcagagagagaaaauguucuaguuccgagaaagcacgagcgaggcuccaggcuggcuuacucagacuugccuagacacccaaccccaccucccauggccccguggaagccccgugagcccccucucaccgguagcgcacagagcgaugaaggucugcgcaugcuugcggaucagggacagcuucuccuuuugcuggggcagcuugcgaaggaugugcucaaugaagucgugaggggugacugcggccagguuccacuucagcuuacccaacacuaccaguucccacuccugcaaagggugggaggaagagggcagagcucuaagaauccauagacugacuccaggcccggguugggggcuggguucccggccagcucugaagaugcuccuuaaggcuccacugcagccucaucugucacugugccccucaugcuuugaaguugcuccuggcucuucuugggcuaaaaaaaagucaggcuccacugaaaauaaugagaggccagguaacuacugccaagaccagccuuuacucuaguuuucuuccuaccucaccccuaccccugacuccacaaaauguucuugccugcccacucagaaaggugggccuauaguaagaucuagcuaaggccacuguggugcugcggugagaauuuguuggcuaagucucuuuacuccucauggaaaaaaaugaugcuuacagaugcagaauagcagaagccuccuuggcccaacuccuuggcagccaguucgcuggccuuuccuugugggggaagaguaucauuuucccucucugcugccaacaccuuccccuuugacacaccaugaagaagucuugggauaugacacucacccuuucaccuaaaucuucacuggccuuugucuucauggcuaaagggccugagguggucacuugugacuccauuuugcacacuaugauuuggggcaauguggaggugcuuaaacagggucagcccauguacugggcuguaacggucucuuuuagggggcuccacugcaccccacuaguaggcuacuuugugccucuccuuuuguaaaauaaacauggggaauaauguucaaaugaacuggacuaaauauaauaauaccccaaagagaugcacaccuggaagugcaugucugggauucuaccucuuuaaggcuagaaguuugaggcuagcuugaaauuaugcaaaggucccaauuuuuguuuguuuugguuucguugggggggggggugcaaacaaaaggaaaugauccuggucaaucaguaggauucaaaagcgcaggaugcuacuacugccgggcagugacugacucuucaguucaccuggcuccaucugcuaaacuuggggaccggcuauaaagccccugucagcuggaccagcuaugguguuuccuggagcaagcuccccucacguguaaaauaggaagguucuucuagggugcauaacuuauggaugggaggagaugggaagcuggcacacuuuauuuggagaauugaguuagcuuugccgguccuggaaaaauuagggugucuugaaaaauaccuccaguccuccagcacaccagacacauagaagauucuuuuucauguuuuguuuuguuuuguuuuuuucuuuuugaauagacaagcuggccuccaauucuaaucuuauuuuuuuuuccuccccacaagcuuucaagucugccuggguuuuuugcaggaaguuaggauaaaaaaaaaaaaauuccuuaacuacguaaaaaucagaaauggcuugaaucccaaacccuuccuucuuccagggcaaugugagcacaaacucguccucuggcaccauuauugaaagaagcagaucuuccagaagaaagcaccuuuaggggccucuuacaccaaaccagaagcagcugaaaucuggcaguguuucaaaggugaagucauucaggccccucuuugcguucuaggcaauuccucccccagccuugcacaugucugccacuagguggcagcacagacccagaaaggacggcuccucacaaagggcucaguucaagaagccagucuuugcccaggagauuaagcaggcccaggcaauggcagcaagggggagggagucgauagaggggguggucuucuuucaccagugcaaggugugcaaaccacuguaaaagagagcugcagaaccuucaguguguggcauuaacauggggguagggggaagugcaugagaaaaaaaaagguagaugguugggagaaaaccaagacaggacccccuggggacuguauccaggucacugugccuuuuggagcugaacucucaugcuucagauccaccaauagaaaggcagauguugauuuugcauccaaguuaauauguucauacuuagugcuuuguugguacuuagugaucagcuacuauguuuguccaugagacuuuauuggucuuuaagacauuaccuguuacaccuccagggucuugggaaacaacacaaacuagaaugugagaaaucagaccguguucucaggguucaguggaaaucuggaccuuaauuauaacaucauuaacuagaauauucuauuuaugccccccccccacccacacacacaacagaauuucacccucaugaauuuccaugaggcacugauagcuuugcucacucccugaugugggaagacuagcucucuccuacuaaaggacaucuuuuuuuuuuuucuuacagucuugguuaguguggcggccuuagugugauggggaagggcagagucaggagcagggagggcggcauuaccagcagcuccuggggcuucacagaguugucgguguaaaugcacagcuuuuccgcagucagcgggauggucucuuucagcuuggaagcuaggaacaugcacacugcacccaggagcugaagaugggucuuaggagucgggacuccagccaagaaacgguccagguaauucauggccagaggaaagaccucuucuucacacuuuuguuccucacagaccuacaaucaagagugggguaggguccgagggggauagggaaaaauuaguaucagaaacagagggaaaagaaaaauaaaagcauaaucugagauaacaaaaagaauuuuuuauguguguguggggagggggaggagaguagaaaggauaguaagaauagagaugagaacggugggguaaauccgaagggcuccugggguucggguauucccgcaaagcugaaaaaggugaugaacuaaaaccuccacaaaccccaaggcaaagcccagagccgccgccgccugccguucccucuggcucacuucucagcacaccaacucacucuuuuuuggauuucgucaucuuuucaaaaaaucaauaaaaauauucuggaagcuccgaaagucuacuucuuggucucguucggauccucagauccuauucuaccauucccgacaauugaaaaaaauguccaggguggucucggcgguccaggggccgcuguucgguggguggguggaggagagagggggagggaggaggaggaagcgcgccucggccggccgccgcaguuggagucggagcaggggggagcaguuucaaaaaauuauuaaaaaucgagggaaaauccuagaaacgcucugugggccugaaaaccccagagaggucccaggcucccuggaaaagagguuucggguguccguaaggucgguaucuccaccccaggggcucuagaucucagugggggaaacuugcggaguguucggcugcggcccacaagggcaguagcuaggaaggcugugccugcuggggguugggugagacgaaaccagggaaccccccuccaggaggcaugcgggacucugaccucucauuugggggugcccccuagccugcucuacacaccuccucccccgcuuccuaccccacccaaaucugcgcgcucaagaagcagccaaacuguaaguaaccuuggugaaccgagggcuggggaagagggcacgaucagaaagagggugcccaggaucauggggugcugagagggggugggggcgccggcgaauguugccaguccuuguaaauggaguuugcaaagcaacauggcgaaaccacggcagguccagagcugugcauacgugggcacccugcucucucggcaaagauugcaagcaaggcuaaagcagcgguucuuucagauugcccuaaacgcacguuuuuuucaguaugacuuccggggcucuccugaauucccuguuucucccccacccccaccuccugccaaagugccaacgcggaguccuaaggcucagacgguuugccccaacccugagagucgggggcgggggggggcucuuuauauguugguauggauuguuaggucgcaacacccucuggggccucacugaaggcagccgggguugcuuccacaccacaggucagaaauggagaugggaagacgaggaagccacaugcaggcacacgcgcgggaugccaaccccccgggggggggaggacauccucacucacccaaguuuuccuccacuaguuaaucuagcaagggacagaauuagcgucucgcccaagggugcggggcuaccucgcgcacgagcgggggaggccagcgcagggguaguucucccgcaguuuuuaggaucucugcguguuggagguagggauggagcggcugggcuugccucucccugagagcgucgcccgcacaccuaccucuagcauccagguggccaccauccugcgcauguacgguuggauguccuucugcacgcacuugaaauaggaacacugcgggagguagcgcuccucgauggucaacagguucugcagaacgcggucuuccagcagguugcgguccggcacggcccugcggaccggguccaccucgcagcacagcagcuccauagccagccggccaccacucggucccgacuguaaauuuuuuuuauuauuauuauuuuuuggaggugcgggggggucggggagugcuucccuuaccuccuuccuuuggcugaaugggagauuugggagaggaaagaaauggcaaagagagagagggagagagagagagaagaguggaaggugggcgagcggagccucaagggccgccugacucgcaccgguccuucccuccgaacugcccggcucuccucagcucgcucuccucucucgcucaggca

SEQ ID NO: 12119 - RNA, 25341 nt, Mus musculus
ugccugagcgagagaggagagcgagcugaggagagccgggcaguucggagggaaggaccggugcgagucaggcggcccuugaggcuccgcucgcccaccuuccacucuucucucucucucucccucucucucuuugccauuucuuuccucucccaaaucucccauucagccaaaggaaggagguaagggaagcacuccccgacccccccgcaccuccaaaaaauaauaauaauaaaaaaaauuuacagucgggaccgagugguggccggcuggcuauggagcugcugugcugcgagguggacccgguccgcagggccgugccggaccgcaaccugcuggaagaccgcguucugcagaaccuguugaccaucgaggagcgcuaccucccgcaguguuccuauuucaagugcgugcagaaggacauccaaccguacaugcgcaggaugguggccaccuggaugcuagagguaggugugcgggcgacgcucucagggagaggcaagcccagccgcuccaucccuaccuccaacacgcagagauccuaaaaacugcgggagaacuaccccugcgcuggccucccccgcucgugcgcgagguagccccgcacccuugggcgagacgcuaauucugucccuugcuagauuaacuaguggaggaaaacuugggugagugaggauguccucccccccccgggggguuggcaucccgcgcgugugccugcauguggcuuccucgucuucccaucuccauuucugaccugugguguggaagcaaccccggcugccuucagugaggccccagaggguguugcgaccuaacaauccauaccaacauauaaagagcccccccccgcccccgacucucaggguuggggcaaaccgucugagccuuaggacuccgcguuggcacuuuggcaggaggugggggugggggagaaacagggaauucaggagagccccggaagucauacugaaaaaaacgugcguuuagggcaaucugaaagaaccgcugcuuuagccuugcuugcaaucuuugccgagagagcagggugcccacguaugcacagcucuggaccugccgugguuucgccauguugcuuugcaaacuccauuuacaaggacuggcaacauucgccggcgcccccacccccucucagcaccccaugauccugggcacccucuuucugaucgugcccucuuccccagcccucgguucaccaagguuacuuacaguuuggcugcuucuugagcgcgcagauuugggugggguaggaagcgggggaggagguguguagagcaggcuagggggcacccccaaaugagaggucagagucccgcaugccuccuggagggggguucccugguuucgucucacccaacccccagcaggcacagccuuccuagcuacugcccuugugggccgcagccgaacacuccgcaaguuucccccacugagaucuagagccccugggguggagauaccgaccuuacggacacccgaaaccucuuuuccagggagccugggaccucucugggguuuucaggcccacagagcguuucuaggauuuucccucgauuuuuaauaauuuuuugaaacugcuccccccugcuccgacuccaacugcggcggccggccgaggcgcgcuuccuccuccucccucccccucucuccuccacccacccaccgaacagcggccccuggaccgccgagaccacccuggacauuuuuuucaauugucgggaaugguagaauaggaucugaggauccgaacgagaccaagaaguagacuuucggagcuuccagaauauuuuuauugauuuuuugaaaagaugacgaaauccaaaaaagagugaguuggugugcugagaagugagccagagggaacggcaggcggcggcggcucugggcuuugccuugggguuuguggagguuuuaguucaucaccuuuuucagcuuugcgggaauacccgaaccccaggagcccuucggauuuaccccaccguucucaucucuauucuuacuauccuuucuacucuccucccccuccccacacacacauaaaaaauucuuuuuguuaucucagauuaugcuuuuauuuuucuuuucccucuguuucugauacuaauuuuucccuaucccccucggacccuaccccacucuugauuguaggucugugaggaacaaaagugugaagaagaggucuuuccucuggccaugaauuaccuggaccguuucuuggcuggagucccgacuccuaagacccaucuucagcuccugggugcagugugcauguuccuagcuuccaagcugaaagagaccaucccgcugacugcggaaaagcugugcauuuacaccgacaacucugugaagccccaggagcugcugguaaugccgcccucccugcuccugacucugcccuuccccaucacacuaaggccgccacacuaaccaagacuguaagaaaaaaaaaaaagauguccuuuaguaggagagagcuagucuucccacaucagggagugagcaaagcuaucagugccucauggaaauucaugagggugaaauucuguuguguguguggguggggggggggcauaaauagaauauucuaguuaaugauguuauaauuaagguccagauuuccacugaacccugagaacacggucugauuucucacauucuaguuuguguuguuucccaagacccuggagguguaacagguaaugucuuaaagaccaauaaagucucauggacaaacauaguagcugaucacuaaguaccaacaaagcacuaaguaugaacauauuaacuuggaugcaaaaucaacaucugccuuucuauugguggaucugaagcaugagaguucagcuccaaaaggcacagugaccuggauacaguccccaggggguccugucuugguuuucucccaaccaucuaccuuuuuuuuucucaugcacuucccccuacccccauguuaaugccacacacugaagguucugcagcucucuuuuacagugguuugcacaccuugcacuggugaaagaagaccacccccucuaucgacucccucccccuugcugccauugccugggccugcuuaaucuccugggcaaagacuggcuucuugaacugagcccuuugugaggagccguccuuucugggucugugcugccaccuaguggcagacaugugcaaggcugggggaggaauugccuagaacgcaaagaggggccugaaugacuucaccuuugaaacacugccagauuucagcugcuucugguuugguguaagaggccccuaaaggugcuuucuucuggaagaucugcuucuuucaauaauggugccagaggacgaguuugugcucacauugcccuggaagaaggaaggguuugggauucaagccauuucugauuuuuacguaguuaaggaauuuuuuuuuuuuuauccuaacuuccugcaaaaaacccaggcagacuugaaagcuuguggggaggaaaaaaaaauaagauuagaauuggaggccagcuugucuauucaaaaagaaaaaaacaaaacaaaacaaaacaugaaaaagaaucuucuaugugucuggugugcuggaggacuggagguauuuuucaagacacccuaauuuuuccaggaccggcaaagcuaacucaauucuccaaauaaagugugccagcuucccaucuccucccauccauaaguuaugcacccuagaagaaccuuccuauuuuacacgugaggggagcuugcuccaggaaacaccauagcugguccagcugacaggggcuuuauagccgguccccaaguuuagcagauggagccaggugaacugaagagucagucacugcccggcaguaguagcauccugcgcuuuugaauccuacugauugaccaggaucauuuccuuuuguuugcacccccccccccaacgaaaccaaaacaaacaaaaauugggaccuuugcauaauuucaagcuagccucaaacuucuagccuuaaagagguagaaucccagacaugcacuuccaggugugcaucucuuugggguauuauuauauuuaguccaguucauuugaacauuauuccccauguuuauuuuacaaaaggagaggcacaaaguagccuacuaguggggugcaguggagcccccuaaaagagaccguuacagcccaguacaugggcugacccuguuuaagcaccuccacauugccccaaaucauagugugcaaaauggagucacaagugaccaccucaggcccuuuagccaugaagacaaaggccagugaagauuuaggugaaagggugagugucauaucccaagacuucuucauggugugucaaaggggaagguguuggcagcagagagggaaaaugauacucuucccccacaaggaaaggccagcgaacuggcugccaaggaguugggccaaggaggcuucugcuauucugcaucuguaagcaucauuuuuuuccaugaggaguaaagagacuuagccaacaaauucucaccgcagcaccacaguggccuuagcuagaucuuacuauaggcccaccuuucugagugggcaggcaagaacauuuuguggagucagggguaggggugagguaggaagaaaacuagaguaaaggcuggucuuggcaguaguuaccuggccucucauuauuuucaguggagccugacuuuuuuuuagcccaagaagagccaggagcaacuucaaagcaugaggggcacagugacagaugaggcugcaguggagccuuaaggagcaucuucagagcuggccgggaacccagcccccaacccgggccuggagucagucuauggauucuuagagcucugcccucuuccucccacccuuugcaggagugggaacugguaguguuggguaagcugaaguggaaccuggccgcagucaccccucacgacuucauugagcacauccuucgcaagcugccccagcaaaaggagaagcugucccugauccgcaagcaugcgcagaccuucaucgcucugugcgcuaccggugagagggggcucacggggcuuccacggggccaugggaggugggguugggugucuaggcaagucugaguaagccagccuggagccucgcucgugcuuucucggaacuagaacauuuucucucucugcuucacucguaaguucuuuaugagggcaaguaugguaaggggaagggagucggugccugcuaaaauauuguuuauggugucuaaagugcccuuugaagauuauagauacugcucucugguuguguuuaaaucuuuaaucuuuugaggaaaaggacggcuuggagauaagcccuaaagggaauuuaaggaaggugggggcaaauauagguuaaaggaccaacgacaagauaaacauggugcccgcccugauaagggggaaggaauuccuucaccguggagcugguuuauugccuucuugcuguuuccuguugacaagggagugaaccuuuaagcaaagauccguuuauucugagcucuggagaggauuuuugauacauagcuuuauuggcuucacaccuggguagaagacccuagcacaacauuucucaaccugugggucgauacaucccacagggcuuacguaucagauauccugcauaucagauauccugcauaucauauaucuacauaagaaaucacaaauagcaaaauuacaguuacaaaguagcaacggaaugguuuuaugguugggggucaccacgguaugaggaacuguauuaacgggucacagcguuaggaagguugagguugagaagcgcugcccuagaaccuugggaauucgggggccaagugucaaaaguucaucuccucaggguuagcagguaaagaaagaauugaucaugaguggggugcagcucaauucauccaggguuguugaaauguguugaugugauaggggguggggggagguggaguguaacauuuuaauuccuuguaacauuuaauuauguguuuguauagcugaugcuauaaugaacaauagggccugugcuuuguuggaaguucagaggucaggcagacuucguuacuuagcacugagugaccucgcucaggcuguuugaccucucugaaguucaucugggaucugcaaaacaggccuuuggauguauccuucccuagccuugguggagugggcagggaaacugacccacagaaaagcaagccuggagcuuccugcgaaaguucacugauguugagaauggcuccaguuaagguggaugcggaaauggauacagccucucacuggcgugccggauuccaucucccuguuuuagaggggugugugugugugugugugugugugugugugugugugugugugugucacgcacacgcgagugcgugcacgcacucaguuugcguugguccagcagcccucggggcccugcaucaggccuuguagcacacuuguggugucccagcuccuucguggaguccccugcuguuccuacagucagggaagaggaugacaauaagaagccccagccuuugcuacgcuuuggacagcacuuucagcucccugcucuucucuugcugacuggccugggcucuagaggucagucccacacugaccugcaguuuuguuuccuaggaacugucucuuuccucuugcagugauucagggugggggaagggucagucagccuuuucucucuggcccuaggacaccuaaccccccggacucauaaauucccacaucacccagcugccaguggccagaguccugcuuugaccuuaucuuuugaccaacaggucuugggggguggggggaggcuuucacuucuuccucccugaucuugcacugggguggggguagggcgauagguggaauuacucgggcuuggauggauuccuccaauucuguauagaccacagguccguucuguguucuuggggaucccaucccccauucuuggccaucuuguccaaauccuuggggcagcugccaacuuuggggcccaaauauggagccugggauucagugacuaggggcagaggcccagugggagguaggggcagucagaaagaugggccuguugggggccuugaccuagcuuuagccaaagagugggaaggggucagaaccaugugccaaguacugcuccagaggcauggacugaugagaaaguggcggaggugcucaggccuccuggggcuggaaugggugggccugaccacaaagcccccaugucucuucuggucugcauuugggguccugcaugugaauaagcuuuggagcccugccgguauguggguguggaagggugguggaggggaguguuggggccagcagacaggcaguaggcuggacagccuaaacccagaggccugcugcucuugaggacguugagcuucuggggccaagaucuagcgaacccaaguucacuagcacccuugaauaauaguaggcucagagcaacucaaggaccaaagaugggagggugcucuugugugccccaucaccucacacccucagucucuuaacuccaguccugaauauuccacccugaaccugaggauggcccaggguuuugaggguucacaaaggcgugggaagggggcagucccugaagaggugguagguagccagcccuggggagacguugcuaguuuaagggaaaagccaauugugaaagagcuggcagucccuccgagggggcgugcugagcguaugugugugugaaaggggaagagagcgugggcaguccgggggcccagggagggaagaguguggccgaccagcagucuuccuuuaugggguucugggguaagguugguggcagggcaaagagguguguccuccuuuccgauccagccuacagugguuucugagagagagguggucugggauugccuggagcugcucuccccgcuggccuuugugguggaggaauuuuagguggggugagaguguaacugcagcuccagcccagaacguguggcucuggagaaggcagaaguggacuucucucuccuggagggcuccaggucagcaaacagggcaaaaagcacccccuccccccuggggguaaccaggaggcuaccaucaaccuuaccauacugagcacaugauuucagugguauugaguuuaaacuugguacagauaccccacaccugccucuuuuugcauugggaguauugcuguggcugcuggacccaacucccuguguaacccuaagguaggguaggaauccuaggguacagccagucuucucuuaaagguguucauuugauuuccagacagugguggcccugaaaagucuggggacuugacucuuguucuagaauguaagccaagccucucugguggccaggaaggaagaaugagacccacauuuccacagugccucugagcugccccuagagggcagucauagggcugggcggggggggggggggggaagaguagcuugucgagcugaaguucuguaacugauaucgcuaucuugcgccucaucuggcccugagaugaaugagagcuuuucuccagccacagcucucuucucucccuuccaccaagcuaaaucgccauuaauaguuauugccuuaaaccauaaaggauagguugugcugaacccuucuggggggugucagauguauggaugcuaagugacaucauggguguccuuugcuguccaaagagcaccccgggucugucugguucuugaaaccugcaccucaccacagguugaaggagaggaagaagccgagacaucagacuuguugguuggguuuccuccaucacaaaccgaucucccucccccuaguggacaacaagaguaaagcagccuccgggagccuuuuguuagcacuacuccuggcuccugcuuuuacuccauauuaauaagcucauugggcaggaccacagcaucccacuuuuaaaucccaucaguguagaacaguuuggccagugaaaucucaugguuuuuuuuuuaaagugcagauuccaaguuggugguuauagagugcuucuccugauucgggagccaccccagacacccagcugcuucuguggaguccuggauauuugguaccacgaggagguggcagaugaaucuagggcccaugugguuggcuucugggcaggagcccuuuuauguuuccuuucguggcauguaggagaaaacguugaggguuacucuaagcacagacuggauuggggucucuuuaaucagagguccagcaccccuagugagugagcaguggcacugagcagucgucugacaccccaagauucccauccucuguacuggguccuuugccugcucccaccaggagggagaaggucaggccugaggcuccucauaggagcuuccaggcucugggugaaccacaccagagucaauguggacugguggcaagcagggugaggguugggagcgugggugaccgaugucuggcaucuaagguuuacccugagccagguucuaugcgugaguuaauagcaucggcucuuguaacuaauccucaggauagcacggugggaaaaaaaaaagguaaauuaguacuuuugauguuguuuuucaagauaggguuucucuguauagcccuggcuguccuggaacucacucuguagaccaggcuggucuugaacucugagaucuuccugcuucugcccccugagugccacuaccacccagcaaauuuguaggucagaaaaauuccuuucaaagauacccauagaguguaaaugaagccaaguaugacacaccaaacuggguuguacugcuggguaguaaacuggcuacccagccauaagaaacugcuacuucuugggagcaccuguuuuuccacuggggaaggaguagaugugcguacuggagcauggaauaaagagccagucagacucugcccaagaaggacuucuuucaguacuuaauaagggaagagguaaauacccccuccccggccugacaccugcaccccaggucaagccgcacaccccuucuggcuccacaugcuaacccugaguugguuuuguuagcagugugacuucaaaguucugcaggaauguugggugaacucccuaucugaugccccagcacgagggggggaacucugagagcacuucagugcccugucacugacaggugcucucacccagggccucugugggcccagggccaugggcuggcuaccucaucuacacuaugaaugccacacacagcagcuaacaaguuuauuagauagagaaugucuccuguaacccauaucggggagacuuacaacacaucaagagccagggagggagguuggcuucaucacaucagccaggauagagaagacauaggcaggggucagcagccagaaggaguugggugaaaucccauaguauauggcccucaaagugaaagugaugagcgguggaaggaacaaagccaaggagacagacagauggccaggccuaccuggcuccugggauugagcccaggugagcaggggagugugugugguucgcugauuuguggggugucuaagaacagucgaaucacgaugcugagguacaaugcugagguacuggcucucucuccauuguaaaagccucucugugaugcucugcugcaagagggcauugcccgaagagaggggaagaguccagguugcucugagcgugccguguucagcccaggauucucacucugagcugaugugugacucaugugucccucugugcucugccuucagucuccacuggacuuacuggugucuugguacaacuagagaucauucacuggaaaguggaccccauuucacagcugccacucgauggugacacugucaacuccuuaaucugugagccccaaggcaggggcaaagacaagaucaacuugacaguucccagguuucauuccauccacaacgucacccuccaugguggcuuuguguguuaaacagauaucacacgcaaugcaugcauguuagcaguuggcaggauucuccucugcauugaaaccagcaguucauggaucacaguuccauggauccccuuagagaaucacucagcggugaaugaguuuaaggucccagguugccccuacuauuuaaggugaauccccugucuuaacucuuagaaaaauacaagugugguuagaauuuguuagucuuuaguguuugagaaaagcccuguccucggcccuaacguucugaagauccuuaaaauaggguuaaaaguugagacucaagagaauuaagccaacucaccuuauucugcuucuacauuuagcuuacaugcacaaacaugcaaaacgcacguauguaugcauaccauaugccugaugacuguggagaccggaagaagguaucagaugccuugagaucggaguuguagacaguucaugugaaugcugaaaaucaaaccuggguccucugaggauggaauaaguacucuagccacugagucaacuccucagccauggaagauaacauguuuuaaucaucucacuaaaagguuccaggcauguguugacuucuugaguaguugucugggcacagagugucugggacucagagccccggaugacuagcuguguacucagauaggcacccuuucucuccugccucugugucuuugagaauaucuacaguugacaagucaauaagggcuuccuguggaaggagggagucaagggagacaguggcuguggauccagggguucuaggggcagcaggucugcgccuuccagcuucugcgcaucagcugucuggcgagcacugggccccguuuuccuucugggccugacuuuaaguuucugguucuuugcagacuucaaguuugccauguacccgccgucgaugauugcaacuggaagcgugggagcagccaucugugggcuucagcaggaugaugaagugaacacacucacgugugaugcccugacagagcugcuggccaagaucacccacacugaugugguagguaccagcucuuuuggcugaguccccuuggcugaaacccgaugucucuccucaaguuccaggaaggaugguugguuuaugaugguggcucagagucuuuuuguuugcguuacuguuuucuugguaucuugucuuuaaaggucaaacuccagcagauugaugccuucccucgagguguguguguguguguguguguguguguguguguguguuacuagggguuggguucucgguaucccaggcaaccacuguaccauugaguuacaucaucagcccuuaaggguuuguuuuguuuuguuuuuagauuuauuuaucuuaugucugugaguacacugucacuaucuucagaugcaccagaagagggcaucuguucccaucacagaugguggugagccaccaugugguugcugggauuugaacucaggaccucagggagugcucuuaaucagugcuuuuaaucucuagcccuccuucucuaaauuuuauugagagacaaucucacaaagaugccuugaauucaugauccuccugccuccgcuucccuauagcugggauuacaggugugcacaaagacugccugcuuccucuuauggguuugaaagcgugcauguaccuuaaaauacagacagaaucucagcaagcugaugggggggggggugggcagucaacugauuuuccucugcaguguaggguucauguccauuuauguucacguugucaggccucugcucugccauggagagaguccaggucuacucacuccccaaugaggugggaaugcacaaagaggggacagcuaaagcugugacagagggagcagauuugagagguggccuugugagugauaucucugccagucagccuucuugccauccugucucgggcuuucuuuuaacucaaaguuuuugguggauggcaaagcacacaaggaucgagugcaguagaaauucgagaacuauuauuagcuuuagucuuuuuccauucuguguggauggccccgaggcugcugcuggcugccagaauucagagaucuuaaacacagagguuuugagauggaccaggaucgcacaagguccugauuucacuggcuaggauguaacaguugaagaggguucuaucugggauaacucucagagcucaguuaccugcaucccuccuccccgcagccccccccgccccccccaggcagcagagaaaggaugcagcagagaggcaggacagguaacagcagagccaguacccaagccucugagcucugucuccagccuggaaacuuugcucaucucuguggcucuugggagcuuuguauuuugcaaaaggcauucaguggaaaggcuaagcagagaggggaguauuguuggcucuuagguucugguguuucaccauggagaggcuuggcuugggaaugcaggggagauucacaagauacccucuggauaugcaggggcauucagacugccccaugagggaguuuacuggguucaagggucacgccguguaaugcacaggccuggggcuggugccucgcagaagucugcaaagcacaggcuguuuaaacucaggaagcucacagccauccagcaacucaccuguauuuggccuugacacuaccucagagaggugaaggccuuaaaggccuugauagagcuaaaccaugggucuuucuuucucugaaccggguuuuaaacagaguauuugaaguguuggugccaaaaagcaugcuuuuuagccaggacucuaggacauggauugugaggcuccccaccuccacccgcagcacagcauggagaauguguuucugacucuccaacguguguguguguguguguguguguguguguguguguguguaggggcucaacccaggcccuaaucuucacuuuuccuaauguguccugcuaaggauuacuucauagauaggauguuagccaguaacaaacuuuucuucaacuucugaacaugcacacgcacacauagacacacaugaugcugugaagguucugugccccaguauaggggauugccagggccaggaagcgggaguggguguguuggugagcaggggaggggagaagggaugugggguuuucagaggggaaacuaggaaaggggauaacauuugaaauguaaauaaagaaaauaucugggcuggugagauggcucagcagguaagaguacugacugcucuuccaaagguccugaguucaaaucccagcgaccacaugguggcucacaaccacccuuaaugagaucugaugcccucuucuggugcaucugaagacagcuacaguguacuuauguauaauaauaaauaaaucuuaaaaaaagaaaugaaaauaucuaauaaaaacacaaaaagacacauguagaaacacacguacacacauauauacacauacauacaaacauauauacacacagacacacacaaugcccacgaagacaguaagggcuggagauaguucagugauuaaaagcuccgacugcucuucuagcaccuggguaugauucccagaaccuacguggcagcucccagugaucuguaccucacacauguggugcacgcauacgugcagacaaagcaccaauacacauaaaaacagauuaauuaaaauucaauaaggaaaagaaaagugugcaggggcggggguccucacaaaugcuagcgugaggcacuuuaagagaggcagggcaugucugcaaaugaacuuaggaugccuaaugcaaaauuugagcagaguaaaaaaauugcaaaauaugucuuugggcuaagagaaacaaaaugugguauggccacaugaugggaugucagaaagccuuccaaaagaaaugucauccuauagacacuaagugcacgguuaagcuugaagacauugugcuaagugaaauaagccagacgcaaaagagaagucauagaugaagcagcuagagaggucaaauucauagaaacaaaaaacggaaggaaaguuggucaaaagguuggaaggaaggcaggaaggaagaaaggaaggaaggaaggaaaacagguagguagggaaguggaacauccuagccauaacauacaguaugaauguacauugcaccaaaaugcaccaaaaaugaucaauuuuaugccauaguaucuuuuuuuuaauuuauuuauauguacaguguucugccuacaugcaugccuacaggccagaagaaggcaccagauccuguuccagauaguuaugagccaccacgugguugcugggaauugaacucacgccuccuggaagagcaaccagugcucuuaacuucuaaagcaucucuccagccccuaugccaugauauuuuauucauauaaauauaccacacucauacagaucaucccugugaaaugccaguuaguguguugcucugucauguggagaaguuaaaccaauccaaauagaagccaggagccacugauagcugacugccauuccugagugcccaccccccccccccccgccccgaguucuacucucacggcuggcccgaggucaagguugaaaguugguccccuggacuccccagccauagcuagacagcaucucccagcucacuggcagcugauagcuggggcugcagggacccacgcggcucugagaaacgggcuuuguuuuccauaugguugccaaaaucaauugacuagcuccauuccgaagagaagucugagcgagaagccugacagucuuacagggacagaggggagucucagaggacaguguauuuuagguccuuuucccuuccagccacaaguuaagaguuacuaaaaacagacacuagccagggaggccugcuuggcucucagggaacuucuacauacccagacuucuguugccaagaggaaguuugagagcagggcuugaccaucccaggcccccacagaauccuguucccuuuccauccccuccacaguguagucuugcugugguucagaguuuaccucacuguucacuugacuguagagccucuugaauaagaccuaccuugaacuuggcuuuuuaucucaagccuccagcagucauuagaaacuaaggcuuggagcaagggagggaaggauggaaggacgaaaggcagacagggcuuucaaaugugccucucauucauucaggaccuuaggaaagauuuaucaucucucuguaucuaccugucuaucuacauguacaaacuuaaacagaagauuuaucuuggagcaaccucuuaauuucacugucagucacacacuuaagucaauauagaguagagcugguaugaggcucagcgugcaagguucaauccccaauaguucaagacagggaaaaaaaaaguugaacugaggcguccaugcuauaaagauuugaggaaguuucuagaagauauauaauagaacaaacagaggcucuaguaauacugucaguucugccucgguuauaacaggaccccuugccguguucuccagaacugccuagaauagauucuagaauauucuucccuuagggucaucuuggcauuuuaugauacaacuucucagcgaguaauuacaaaacaaauaacuuaaguaagcauugcucacuuuggacccaaacuuuucuggggagaggggguccccaucaucucuucugucccccgccccccuuggcuugaaacuuguauucucaaagugccucugacuaauaccaccuucagugugcuuaaggggggcuucggggagguaggaauucuggaaagcaugccuggggguggggaggcggguagagcugggggcugccucccucccucccucccucccucccucauuucuuguccaccucauucuguaugcaaggaaacgagccaagcagcccgcgaagaaagcaagaaugagauaguuuccuaaguugucucugccugaguuggcggcgggucugcagcucauucagcucuuugucccacuguugagugcagugcguguguacugacaauggguggaugcaguuacaccaggggcuaaugguuggaguuccguggguccauucauggaggcaguggagggugcggggcagagagcucgagccagcaaguggaggaagucggggggccugaguaacgagccagagaucacagccgcugcugucagggcucugaggaugggggggggggggcaguacagggagggacccgucaucagaggaguuggaggggugcccgaccuccagcgcaguggaguaccaccuguccgggcugacagacuagcauuauggcuuuccuuuuaaucagcuuaauuuggggcaucuuaacacaaugccugcugcuuucggaggcugccacaaagcugagguccuggaguuccugcuugucacauggauguagcaucuuuugaucagggaaacuguuaucaucaccccuacacacacacacacacacacacacacacaggcaugcuugcacaaacccauguucagacuccccugcaaacuguuaucaucaccccuacacacacacacacacacacacacacacacagaggcaugcuuacacaaacccauguucagacuccccugcagugguguuuucuuccuugcuuuuugccagcucacagaaaaguacagaaaguacauuugcacuauggcuccaagaggggcuccugcaaagcuggggcgguuguaacuguugggauugauugauggaugauugaucgguggaugauugauugauugauugauugaugauugauggauguuggaggaauaccauguaggucucuccacccucaggaaggaauauguucuacacuuccugcagauagaggauuucuaccuggccgagccaggacugagggacccuuguugaagguagagcuaauaacugaccacuuaugaggaaguggaagcugauagacagcaguuaagcagaccugauggguuuagcagucucccaggugaauggcagaugacucuguagccauguuucguaggcuaacugcaucaguccuuguuccucucuccaaaugagagggagcaaagaucagggaucauccagucaguaaugauuugaauuucaguuaacacugggaagggagagcauagaguuuacaugaaaccuuuggaucuuccuccagugcuuagacuacuuggugagcauacccuuggcuggaccauuacaucaugcuugcaucaucuugagcucuuggcucugaacgugcaguagaaaugacugccagaugucuugucuucccuguagggguuucucccaacuaucccuuuaaaaucuugggcagcuagaagggaaggcuuacuguaggaagaguagggacacugcagauccuaacgccaaguucuuaagcuuucugcaggcugauuuaugaagaccaucuggcaucauuaauacaauagagauguacaagggucgugaugacgggguagaugugccaacccagaugaucuuuuccgggaaucagaagauagcggacuaguuuaaaaaaaaaaaaaaaaaaggguuguauggacuuggccaagaggcacaaaacuuccuacuguagagcagagucucccguguacauuacaucagaaaauauucaccaaguaaccccacacacacacacacacaccguaaagauuccucaucauuuauagaaggucucacucugcagcccaggcugucuucagaggcauaauccuccagccuucuccucagccagcuuccuuucaaauggagugguuccgaguucuccucucaagccccaccacauagacccagccucacgaaggaucccucaucagcuacaaauccuacuguuguaaaauaccagaagcuuccaggccucagguaggauuugauuucugaggccagguacaugauuggaggcauggauaugguugcugucucugguauugggguguucccacucauucucucugccuuccaggaaaaagcuauuuacacaucaccaaaugcugccagauuggccuagcaggaaacauggcaaacaaaugagaagcugucaggaccugaguuuuuaauugcuaaugaggguggcaggucccaaggaucaggaugagagauguuagagccugggcacaugaguccuuuacuugguccuguuaaaauuagccuggugacccggugacccccgcccccaaugcuggaccacacuaucucuaggauuaaccuucgacacauccuugucuuaaguaguuggugaucuauaccuuuguucacagaaauauaggaugggcguguuuguguacuuaaaguuucaacuacucagccagccugagaaacaugagucucaaaauccaaaggauucuuucagauuccuggacagauggagccauuaaaacacacacacacacacacacacaccaaucauuuauugauuugcuacuuagcucuucauuuuuauacuuggagaaaccgggguuugcaaauggagcugugcccugccagcaccgagugagcaccagacauccccauccugcuucccgcccuucccagguucaggagaacguuucagccaaugaccuucgcucuugaucugcugccaugccucaucuucaagcuacaguuugaacuggggggcagaugagagaugggaaagaauaaaaauggaggugucauguggggggggggggaugaggagcaguagggugggcggggguagaggaugcaaacuuuugcuccuuaguaguuauugccaacuuuauuuucaggucucuggaaaauaaagauaaugccuuuauguuuguggaaaaaaaauaucaauuccuagguggugaggucuaagcagaaaaauaaacagagggaaguuuauggugaacugugagcagauaccaggagauucgaguuagcaccguuucuauacgcacaggaugcuuccuagugcagggaggugggacggagaaacuagggugaaaaucccugcuaggggcuccccuccccccaaccuucuagccugagccuuagucccaucccagugacagccaugacuugcccucacauuccaugucucccagcaaauagaaaucuucugccugggacagcucacucuggauuuucccuaccaaauauagacuaauaaaggcaacacugcaaaaucuugcuuauucccaaauuggacaagcucaagugucccgaguuuuguaaacaguaugcauuguguuuuugcgaaagggguccaagggugguaaaagaaugcagagauguuuaagcaccgcccuucuauccguuccacgguugcuugcuugacuuacaguguaacaccuugcaggaaccagacuuucugugccaccuuucccagacagagagaccuccagcuggucccuugauaaccaggcaagggcuuuuuguagcuggaucaccuuccagucaaugcaguuuggaauaggaaacacuuaggcguccgcugaugcgcugguucugaccagcuugaucugggauaggcugcuagcuaguucccagauggugcugaugcugccugcuguggccccccacuuuguauacugaguaguuuccauggcauuugagaacauuucuauucuuaccucacaggaaaaucaggaugugaguuggaucgcgcgucugccuuugagaggcguucuaugcauuugcaugugcuaauagccccggucuggaccucucuccucuaggauugucucaaagccugccaggagcaaaucgaagcucugcugcugaacagccugcagcaguuccgucaagagcagcauaacgccggauccaagucuguggaagauccggaccaagccaccaccccuacagacgugcgggauguugaccugugaggaagccauucgggcggcaagagagaggcguguucgucaucugcuagccccuucucucucuaguuaugucuuguucuuuguguuuuuaggaugaaacuucaaaaaagaaaaaaaaaaaacaaaaaacaaaaacaaaaucugcccccaccuagauccuauuuaaaggucuuuuagaagugagaggaaaaggccguauaguuguaacgcauguggugccuguucaaaguccugcauaaggggaucccuguacacucgaaccguuauuauuugaugauguaaaagucauagugagaugcuuacaggagaacccgcagacuagcuagagagugugcguaccugcaacaugggaacgaauuagaggagacugucuuuugugcuugugaccuagugcauaugcccccuuuaguagaauugcaaggaaccgugggugccaggaccgcaugaguaguuugcaaagcagugaacccaaggaggaaucagaaacgagaagggacaugccggggagguugcgcaaaaccacccaaccacaugacugaaccauuuuggauguaagaagcgccuugaugccucaccacguguucccaagacugagcguccgggucucuccgucgcauacucuugcugacuaaaguagcugcuaccuaagggauaugucuuuugccaguuggacacaggugaacggcuccuaagucucauguuuggugaauuugggcuucuacuuccaaacaugguucauuguagauguauuuuacuguuaucugauggagggaauucgcuaugggccaugaccaaaacgcaucuaaaugggggcagauggagaccauagacggaaucuaaaacaaagcugccuuguguaagggaagagggugaggugaucuuuaauccccuuguuaagaaaaagaaaaaaagaaacuaccccuaacuuuuggugcugauuagcaugucugguccacuguuuaacuuuguuauaaaccauuccauuagaaaagcacuuugaaaauuuugggggaggguggggugggauaugggaugguuuaugcaaaucauguugaauacgccuuccuccuuugccccuccccuuccugacccucguccaguuacuguucauuucuggagucugauguucugguacccagcucuggugucccugccagggcugagaaagcccucugcugauauccucaucccagcauucuucggaaaaccugucaacagaggucuaaagcauugugauggcuuagaaggauugaauccccgucuauguuuuucuccuuuggacauggaaagaaagguuacuucugaugcacaggcugaacaucaggguguggcauuuuggucccuuuuccguuuuuuguuuguuuguuuguuuguuuguaauuuuagugcaaaguuguauucauuguacuugaagaccccccucucccacuucuuggagacagucaguaaacagaagugggagccacaguugguuugguuuuguuuuguuuuuuuuuguuuuuuuuuuuuugcacaauuauaauugacagguuaugaagcuauuuguuaaaauaucugcuuuguuuuuuuuuuuuugagaaaagaucagaacagggcugcuuugaagaguuauacacagguucugccuuguuucacagugugaggguugaagauggagaaacaucuaagggucucuuaucuuucauuuuuucuuuuguucuguuuauuauuauuauuuuucgcugcuaagaagcuaagaucguucacccccauucacauuaacaguaccuagcuguaauguuucacggugugcugcuauuuuagaaacauuguuauaauauauuauuuuacugcuuaaauuucaagucccgagguagauggucgagagacgaguucucuguacuggaaaagccuuuuccucugucccuguccuucugguagcaucgaugggcugcguugcguuugguuccguuugguuccuuuucuuccgugccucuucauuaccagguuuucuuuccuccucugaccacauucuucaaagagaguauucuuuaccucagguuuacuggacaaaaacaaaacaaaacaaaaccaauagugauaacaauguacuucuuuucguuuuccuaauaccucacagcuauaccggaucuguuuggaaggccgcuggcacgaggcacagggcaggcagaagacaggaacuggacauccuccuugauagaaagcaggagaaaccugaccccagagucucaggccaggggucuucucugucuugaagauugccaggcuccccuuugacgcaggcucccuucuuaugauagaagacagugacgaagggcuccucuacccaaggcagauacucaucaaacacagacaguggacuaggucagccugauuugcaugcgugcaccagggucugcaaugaagaauucuggcagacaguuaggagacccucccuccaucuuguagcccauucagacacaggacuuuccucuucauggggucccuucaucaugaacauugaccaguuuccuucuuggcaucuauaccccaacuucggauggccuccgaagucuuccuaggacugagucugguuggugcugagucuacagcacacguggaugauauuccuuucuccuucucuuguccucugcagucuacagugacaggcaagugcugugcguggccagguugucuguguguagcauugaauggcuucaggguuuggaucccguugaguggggcaagguaggaggcccaaguugaaugagucuggaaugcaaguugaaagaagggagaggcuguuucuguggucucggguguauuuaggaaggauugggacuuggugaguuagcgagacccuaaauucuaggggcuuugugguaggacggugggugaugguuugggaaguuugagagagaaaacgggagcagccugcagcuagccaguguuuauccagagcucacgcacugcacagcacacucuucugguccuuaagggaccccacagaacuugacagacacacucccuugaguucuugggcaacuuggguaccugaugaguggccuuugagcuuaacugaaacauugaaugaaggaagcugacacacaaggggagaggcagguuacuaucugccccuccaucccucuuaccuggaaccuaagacacucuuccuguuugccuuccuuggagccuaguggaacgaguccuguagaguggccauucugccugcuccucacuuacacaaaggaagggagccuggauuccuuggugaccaauaccuucugcuuagaugugggucuccuugguaguauuucugucucagagggguauaaacgaccccaaggauuucagcuugcucuccccaagccccuucguauccuacagaagggguugcagauucuggucuuuuucugccuugcuaaugaucucuucuuuguuucuaauuugucauuguuguuuguuuuuguuuguucuuguuuuuuuucuccaucagugggggcuaagucguucccccagccugccaaauuuugauccuucccuguuuugaccaaauccuaggggaaagaaacccuaguaugccaaaaauaauaugcuaagcauaaggagauucauaaugguuccuaagaaccaggcagccugugaguggugagcugcuucuagaugggacagcuuguagaggcugcuuugguuugaacuguccccaggacaccacgggaaagcagagcccgucauauagguugcuagcuuuaaggugcaugccuacugacacgggacuccucucuagcagccaggcuggggguacauguagcaccccuggaucccaucuuguugcuagcaggguaagugaccccucagagggagcuuaagagcuuuccuauagucuagcucuuuggggacccaccagacugugccuugggaauuauaggagcaacaggcuaagacaggguggcuuucacaaagaaggcagaggagcuuugucuccaugaggacagggcugggaggaccacacuugucccuguguccuggacaguggugugggaacuggagguagcaaucagaagucuaaguaagccagcugaccucuaagcccaaaggacucccccuugcuuaccuuagacaguccaaccuugggaauagcuuuaaaaaggggaauuaauacugagacagugaaguccccuuaagccgacaagcccuccauaggugcacaccgcacacauaggcuucucucagugcagacuccaggugguggucaacagcugcggcaugcuuaucuauuuguacgaaauaguguagggaagccccaggagguguuauagcuuccauauaccauguggcuuuugauguuucuggauuuucaacagcacaaaagaguccucgagccggaacaugcgcuacuccgauuuuaaacguggcugggcugugagacccguucuuggcucugguuuuacgaagccaucaauacauacacacccuugauggagcugcagauccguuccuuuuccugcagcccacuugugggggaaaagugccuuacugacuuacaguagccacucaguuucaacaggugccuaucuuugacaaaaaaaaaccacaaaaaacaaaaaaaaaaaaaacaaaaaaaaaaacagaaaagaaaaaaaacguuaaa

SEQ ID NO: 12120 - RNA, 8698 nt, Mus musculus
caugcgagcggggagcccaggaggcggcggcgacaccagcaagcaagcagcagcagcggugauccggacacgaagacuccagaagcagcagcagucacugcaguuagagcagcaggagcagcagcaaggugccucaauagcaacccacucggcgggcgagcccuccagaaggcaaccgcccgccaccccaucgccuccuuucuccggaguguucaugcccccggggugagugagcaccccgauucccgaagcugcuuacgagcggcaaggcccggagggcucccuggaggaggugacggggugcacgggccgauaggacggucgccuugcauucccgcagcuugugccccagcuuucaucacugggacuaaggcugggccaggcgggcgggaaggaagcaccugggacucagggcgcccugucugggcgcacaggugccacagcggucuggcggguuuguuuacaaacaaugggguucgggcucgcccgcgcccccugguggcuagugagaccugggaggagcguggccccgggcucgcucgagucccccgagucccacugcgggaggguuggggugggggguggcaccgaggaucggccacacccagagcgcgcgcccgccgggggcggcgacagggggcggcggaggcuguggcucccgcgggcgggggcugcgccccagcaacagccgguuauuggccccgcgcgcgcugggcgggcggggcgggcgcacguggcggcgucgagggggggggcugugacagcggaggggcggcggggaccgcgcgugcggggcuguggaucugcaggugucucgccugggugugugugcucguguuuggcucccgaguuuguaucccuacaccgagauguuggcguuugucacccggaggggugucugcgugaguccuugcccgcgugucugcgggguggggugcaccuguccguuuacggguguggguggccaccccccaaaccagaguuguauacgugugcucuuaaggggugaaaaggggaucuguaucugucgcuugccugguaguguugguggugguggugcggacgaccggggcacuugagcuguguuugugugucgcuugagugagcuguguugcugugcaggggucucgcccaagugugcgcugcguguguguguguguguguguguguguguguguguguguguguaugcgcgcgcgcgcgugcugucucugggugucuccaagacaagcaucugcuguacccagcuuuugggaugggaugccacccagugccugaucgcucgcugggugacuucugagcagcaaaaggcacacaaggcacgcugagcaugaagggcuuugggggugggggggaucuagcggguucagugccagccccucucucugcaugcagugugugugugugugugugugugugugugugugugugugagaaagagagaggggggggugagagugaguuuugggucugagggguuugucucugugauccaggcuaugugucauguggugcucucucucuguaguguuuauagcagucacgugaggccaguguuuucugucucugcauuaggugugugugcugcugggcucuguguguguguguguguguguguguguguguguuuucuggggcugacaguuggcugugguguauuggggcugagaguagaggcuggaccuauggcuucuaccagcugcggcuggugccucccgauguggcugccccgcacacgaggggggaugauguaucuggauaugaugacuugugucuauguguggcuguugugucccaggagcucaaaguugggggggggugcacauucagguguguuuugagaugaugguggugcaugugcuaaggaauaguaaggggggugucuuuggguugucuguguguaugcgggagaaacacguugaagacuugagucuguugugcuucagugugugacggcugcauugugggcgggugagcgcuggcaugucagcagcgggucagugugagacugguguaaauauguugaaagggcucuggauggcugugugugcaugucuguguccccauguguuucugggugagccaccucacugggggagcgggaggggcgguaaaguuggacacuucucugaguucacuggugucuucccauuacacacacacacacacacacacacacacacacacacacacacacgguucucugacagcaccguguauccugggagccccagcaccccuucugcgcucuucucuguugagaaaguucucccuggcccaagcccugagaguaguaggcaguuuuccugguggguuuugcuacaaaccccagacgcagucugugcgccccucaccaugugucccggccaggcugucccuggggucaucccuuccugggugggagugacuuccaggcagggugucugcgaggugggguccugcaggccccccccgcagucgccccacugaccucccgccgugucccgcaggcuccagggagcgccauggcccgcgcacgccaggagggcagcucuccggagcccguagagggucuagcccgcgacaguccgcgccccuucccgcucggccgccugaugcccuccgcuguauccugcagccuuugcgagcccggccugcccgccgccccugcugccccugccuugcugccggccgccuaccucugcgcccccaccgcuccaccugccgucaccgccgcccuggggggcccccgcuggccugggggucaccgcagccggcccagaggcccgcgcccggacggugagugcccgccccgcacccggggaagcugaagcgggaguggagcugaguggggccaccgggaggguguggccaguguggucuuuguguagcaagaaccaggaagacagagugggagacauggauggaggggccaagucgagugggaagucccucuuagaaucugacugcaguccccggaguugcaguccacgucccuucccgggccucgggcaacagcuguuucucagcuccccucccccagcccgggucccugggcgccccccacccccaugaggauugcagugggaaggaguguggccagugggaggacugucaccucaggacuuuggggaggggucggaggccuuacccuuuuauuugaaucucuuuggcacuggcaggguuaguccgcagucccccaggaggaaggagagggggaggggccauuguguugggaaagucccccucggggagagggugaggcucagggagggaaggguuaaaggucccucgccugaugggcuguuaacccuguggugcccggcuacggggaaugaccaucuggguuucccuuucuauuugcccccaccuccccaugaagagagaaaaacuuuccaacuuucccugcguuucaggacuagguucagagauaauggaaacugaggcucaggaucuagugugacaggaccgaggcacaaggaugagugccagaggggguggagcacaaagucuaacccaguaccccugccacccucacccaaacccuaguccucuuggguuagucccaguuuggccuucuggucaucaggccaaugccacauccggggguguggccucacugugguugggcaggagugagcuggagaccugaggguagugacuggguggggucaguggcgguauccccgugugaccuuggucacuucuauggguggagccucaguuuccccgucugucaaauagaacaggcuagauuugacccuguauuaaaauagggguacuuaggucggauaaguugagggacuuccacauucauaugagcuuuaauggguaauugaccauccaggugaccccagagccacuuccguaagaccccuuucuagggccugugggaaagagugggaaaaagggaauuucuauggcugaguggagaagaaagcacaguguagcuccugggcgccuccgggcagacuggguggauggugaccacgccccuuuccccucacccagguccucagcccucccugucaccagcccagcagcacuuagagucgcccgugcccagcgccccggaggcccuggcaggaggccccacccaagcugccccgggagugcguguggaggaggaggagugggcccgggagaucggggcccagcugcggcggauggcggacgaccucaacgcgcaguacgagcggcgggugagugcggggcggcaggcagguggggagggggcugcacaccccgccagaugugcugcagcugcuggcccagcgcgcgcgaggucgcgccagggacaagcagaugggggugugggggaaggaauggaucugcuggaugcugggauccggugugggccagaucaggacuggagccccuagccagggucggggaaagcuacucggagcccgcggucgcggggacugagggcggcgcucggcgcggcggcuccuauaucccgggcuauuuauagccggugagucagcaacgcgccgcgcccgccgcgcccgcccccgccgaacugcgccccgcagcgccucccgccggcugcuucgcgccggcaccucccuggcucgggcccgccacuuggugcuccuagaucggagccccccaugaaacccccagagcccgguucccgccccuagcgcugugcacucugcacauggcccuugcauuguuugcugauuucaacagagagagagagagagagagaggcgcaccccacugacguuggauggguacaggucccucacucugcucccuggcccugucgccuaccuuuuguaaaagggacauccucccagcagcgacucacucccagcagguguuuuuuuugcacccacuuacaugcacagccaggggcguuguuuuuagcucccauccuggcucuggcgcgccuucuaacuauggcuuuccaaaguccuccaucuccuucauugguuaccacugagcaaauccuagagacuaggcaaguagcauggcccgguggcagcaucccguaaucccaccuacucagggagggagaaagaaaguucaaagccagccugggcaaccuagugagugauauucugcuucagaaauagucuuugaaguggcucagaggauaaaggugcuugcuaccaaaacugaugaacagaguucgauucccaggacccacuuaguaaaagucaagagucuaaucuuacauaguguucucuaaccuccacaugugcacacacagauccccccucucucucucuuucucauacacacacagacacacacacacacacacacacacacacacacacacauuaaugguuaagagaacucuuacagagaaccagggucagguucccagcugacaacugccuguaauuccagguccagggauccaaugccuucugguauuugccagcacguacacauuaguuuguuuguuaguuaguuuguuuuuuaaagauuuauuuauuuuauguuuaaugaguacacuguugcugucuucagacacaggagaagagagcaucagaugguugugagucaccaugugguugcugggauuugaacucaggaccucuggaagagcagucagugcucuuaacggcugagccaucucuccagcccacauauuauuuuuuuuuuaguuuuauuuauuuacuuauuuauaauucaggggaggcugauguagcucaguugguagagugcuugccuaggagagagacacugacccuuaggucugugggucaaggucacccucaaauacaguuucaguuccaggacauccugugcgacaugaggugaggucucaaaaacaggaagauuuuuuucuuuuuuuuucuuuuguuuuuucgagacaggguuucucuguguaguccuggcuguccugcaacucacucuguagacuaggcaaacuggccgggaacucagagguucucuccuccugcccuucccccacucaagugcugggcuuaaagguuccacucagcugagcuuuuuuuuuuuuuuuuaaacacaugccuggaauccaccagugaguggcaaaagguguggcuuagcagcaaacauugucuagcauuaguguuuucuccucuuuucuaagagauggccaucucuggcuuggcccaugugcuguugucuucagagugaacacccagggcuccgugcucccccuaauaggcuaaguauaaugauagugaacucacaagguggcauccaccaccucgcccaguugcaaggaggaggagggcacaggaggccugggcuaguucugggcauguacucuaauagggucauuagccugacaucuuccaaauggauuacauucuucacaaccaagaacaugagcccgguggaucugcuuggccauaaccaguggaaggaccaaauaaaagcuugcucucucucucucucucucucucucucucucucucucucucucucuuccguucuuccuuccuuccuuucucccuuccuuucuuucucuuuucuuuucuuuucuuuucuuuucuuuucuuuucuuucuuucuuucuuucuuucuuucuuucucucacucucccucccacccucccuuuccuuccuuccuuccuuccuuccuaccuuccuuccuucuuuccuuccaacacuggcuguccuagaacacacuauguagaccaccaugcuagccuugaauucucagagaucugccugccucugccucacaaguucuaagauuaaagaugugagcuaccacacccagcauucuuucuuucucucucucucucuuucucucuuucuuuuucucuuuuccuuuuuuuuucuuucuuuccuuuucuuucuuuuucuuuuucuuuuuuaggcuggcucuuaauaagcuguucacacuggcuuugaacucacuuuauagcucagacaggcuuugaacuuuugucuuccugccucagccuccugagucgcugggauuacaggccugugccaucacagaagaaaucuagaugcuacaucacacuuuuucucuaccaccagggaucgaacaagaguuucccugaagccagcauugccaagagauaccuucucucagccuugcuggcauggccugcuguucucaacacucuuccggggugguuugagaacugcuuaggcugucgggcugcuccuuacucucucccaugucccaacagccuuuuguuugguugguuugauuuuuccaguuaggagccugugcucuagcacaaauuuagugaggcacacuaagaugaguucgagccaccacgccugucucucaccuugagugggcugcguuucagcccaccccuuagagcccuugugauucguagggugugugugcuaggcucuaugcuaugggaauucugccccagccccuucccaccuagguugggagagugugcccuggugagugaggggcugaaaaauggcugguaagaggguugcgcucaguuuugggaccgaucucgaacccacaccuuuugcucacuaacccacugucugcggguccaagcuaauuccuacuuccuccucuccccagagacaagaagagcagcaucgacaccgacccucacccuggagggucauguacaaucucuucaugggacuccuccccuuacccagggauccuggagccccagaaauggagcccaacuaggugccuacacccgcccgggggacgucggagacuuggggggcaggacccccuccgccuucugacacccuggccagcgcgggggacuuuuucugcaccauguagcauacuggacugccagccuugcccgucccaggggcaggcaagggaugccacucgagcccgggcagccugggugcacugauggagauacggacuuggggggacccuggccucccgaaagccagggaagggagggcugaaggacucauggugacugaggggguggggaccgagccgcccgccucugccgcccaccaccaucucaggaaaggcugcuggugcuggcugcccguuccagcugcaggggggacgcuggggguguccccagugcgccuucacuuugggccuggccucaggccccuggugcuucccccccuccuccugaggagggggucugugaagagcauaugagccaaaccugaccacuagccuccuggagccagagaauggggggcgugugaaggccuucuuaacccagugcccagccaucuucccugagccgccggcgggcggugaacgaugccugccucaccuucaucuggggguguccaggagggguccagacugugaauccugugcucugcccgggaccacccccccccccccaauccccauccaucucauugcauagguuuagagagagcacgugugaccacuggcauucauuuggggggugggagauauuggcggaagccaccccagccuuaguccccagggcaaagcgcuggggaggaagauggggagucagggaggggggaagucucagaagagggaggagucugggagcggggagggacggcccagccuguaagauacuguacaugcacugcuguagauauacuggaaugaauuuucuguacauguuugguuaauuuuuuuuguacaugauuuuuguauguuuccuuuucaauaaaaucagauugaacagugaacacucuuuuuguuagcuuuaccagugacagagcaucuggcacuaccuguaaggacaugaaagaaacgguguguguguguaugugugugugugugugugugugugugugugagaaauggcucagugguua

SEQ ID NO: 12121 - RNA, 8698 nt, Mus musculus
uaaccacugagccauuucucacacacacacacacacacacacacacacauacacacacacaccguuucuuucauguccuuacagguagugccagaugcucugucacugguaaagcuaacaaaaagaguguucacuguucaaucugauuuuauugaaaaggaaacauacaaaaaucauguacaaaaaaaauuaaccaaacauguacagaaaauucauuccaguauaucuacagcagugcauguacaguaucuuacaggcugggccgucccuccccgcucccagacuccucccucuucugagacuuccccccucccugacuccccaucuuccuccccagcgcuuugcccuggggacuaaggcugggguggcuuccgccaauaucucccaccccccaaaugaaugccaguggucacacgugcucucucuaaaccuaugcaaugagauggauggggauuggggggggggggguggucccgggcagagcacaggauucacagucuggaccccuccuggacacccccagaugaaggugaggcaggcaucguucaccgcccgccggcggcucagggaagauggcugggcacuggguuaagaaggccuucacacgccccccauucucuggcuccaggaggcuaguggucagguuuggcucauaugcucuucacagacccccuccucaggaggagggggggaagcaccaggggccugaggccaggcccaaagugaaggcgcacuggggacacccccagcguccccccugcagcuggaacgggcagccagcaccagcagccuuuccugagaugguggugggcggcagaggcgggcggcucgguccccacccccucagucaccaugaguccuucagcccucccuucccuggcuuucgggaggccaggguccccccaaguccguaucuccaucagugcacccaggcugcccgggcucgaguggcaucccuugccugccccugggacgggcaaggcuggcaguccaguaugcuacauggugcagaaaaagucccccgcgcuggccagggugucagaaggcggaggggguccugccccccaagucuccgacgucccccgggcggguguaggcaccuaguugggcuccauuucuggggcuccaggaucccuggguaaggggaggagucccaugaagagauuguacaugacccuccagggugagggucggugucgaugcugcucuucuugucucuggggagaggaggaaguaggaauuagcuuggacccgcagacaguggguuagugagcaaaagguguggguucgagaucggucccaaaacugagcgcaacccucuuaccagccauuuuucagccccucacucaccagggcacacucucccaaccuaggugggaaggggcuggggcagaauucccauagcauagagccuagcacacacacccuacgaaucacaagggcucuaaggggugggcugaaacgcagcccacucaaggugagagacaggcgugguggcucgaacucaucuuagugugccucacuaaauuugugcuagagcacaggcuccuaacuggaaaaaucaaaccaaccaaacaaaaggcuguugggacaugggagagaguaaggagcagcccgacagccuaagcaguucucaaaccaccccggaagaguguugagaacagcaggccaugccagcaaggcugagagaagguaucucuuggcaaugcuggcuucagggaaacucuuguucgaucccuggugguagagaaaaagugugauguagcaucuagauuucuucugugauggcacaggccuguaaucccagcgacucaggaggcugaggcaggaagacaaaaguucaaagccugucugagcuauaaagugaguucaaagccagugugaacagcuuauuaagagccagccuaaaaaagaaaaagaaaaagaaagaaaaggaaagaaagaaaaaaaaaggaaaagagaaaaagaaagagagaaagagagagagagagaaagaaagaaugcugggugugguagcucacaucuuuaaucuuagaacuugugaggcagaggcaggcagaucucugagaauucaaggcuagcaugguggucuacauaguguguucuaggacagccaguguuggaaggaaagaaggaaggaagguaggaaggaaggaaggaaggaaggaaagggagggugggagggagagugagagaaagaaagaaagaaagaaagaaagaaagaaaagaaaagaaaagaaaagaaaagaaaagaaaagagaaagaaaggaagggagaaaggaaggaaggaagaacggaagagagagagagagagagagagagagagagagagagagagagagagcaagcuuuuauuugguccuuccacugguuauggccaagcagauccaccgggcucauguucuugguugugaagaauguaauccauuuggaagaugucaggcuaaugacccuauuagaguacaugcccagaacuagcccaggccuccugugcccuccuccuccuugcaacugggcgaggugguggaugccaccuugugaguucacuaucauuauacuuagccuauuagggggagcacggagcccuggguguucacucugaagacaacagcacaugggccaagccagagauggccaucucuuagaaaagaggagaaaacacuaaugcuagacaauguuugcugcuaagccacaccuuuugccacucacugguggauuccaggcauguguuuaaaaaaaaaaaaaaaagcucagcugaguggaaccuuuaagcccagcacuugagugggggaagggcaggaggagagaaccucugaguucccggccaguuugccuagucuacagagugaguugcaggacagccaggacuacacagagaaacccugucucgaaaaaacaaaagaaaaaaaaagaaaaaaaucuuccuguuuuugagaccucaccucaugucgcacaggauguccuggaacugaaacuguauuugagggugaccuugacccacagaccuaagggucagugucucucuccuaggcaagcacucuaccaacugagcuacaucagccuccccugaauuauaaauaaguaaauaaauaaaacuaaaaaaaaaauaauaugugggcuggagagauggcucagccguuaagagcacugacugcucuuccagagguccugaguucaaaucccagcaaccacauggugacucacaaccaucugaugcucucuucuccugugucugaagacagcaacaguguacucauuaaacauaaaauaaauaaaucuuuaaaaaacaaacuaacuaacaaacaaacuaauguguacgugcuggcaaauaccagaaggcauuggaucccuggaccuggaauuacaggcaguugucagcugggaaccugacccugguucucuguaagaguucucuuaaccauuaaugugugugugugugugugugugugugugugugugugucuguguguguaugagaaagagagagagaggggggaucugugugugcacauguggagguuagagaacacuauguaagauuagacucuugacuuuuacuaaguggguccugggaaucgaacucuguucaucaguuuugguagcaagcaccuuuauccucugagccacuucaaagacuauuucugaagcagaauaucacucacuagguugcccaggcuggcuuugaacuuucuuucucccucccugaguaggugggauuacgggaugcugccaccgggccaugcuacuugccuagucucuaggauuugcucagugguaaccaaugaaggagauggaggacuuuggaaagccauaguuagaaggcgcgccagagccaggaugggagcuaaaaacaacgccccuggcugugcauguaagugggugcaaaaaaaacaccugcugggagugagucgcugcugggaggaugucccuuuuacaaaagguaggcgacagggccagggagcagagugagggaccuguacccauccaacgucaguggggugcgccucucucucucucucucucucuguugaaaucagcaaacaaugcaagggccaugugcagagugcacagcgcuaggggcgggaaccgggcucuggggguuucauggggggcuccgaucuaggagcaccaaguggcgggcccgagccagggaggugccggcgcgaagcagccggcgggaggcgcugcggggcgcaguucggcgggggcgggcgcggcgggcgcggcgcguugcugacucaccggcuauaaauagcccgggauauaggagccgccgcgccgagcgccgcccucaguccccgcgaccgcgggcuccgaguagcuuuccccgacccuggcuaggggcuccaguccugaucuggcccacaccggaucccagcauccagcagauccauuccuucccccacacccccaucugcuugucccuggcgcgaccucgcgcgcgcugggccagcagcugcagcacaucuggcggggugugcagcccccuccccaccugccugccgccccgcacucacccgccgcucguacugcgcguugaggucguccgccauccgccgcagcugggccccgaucucccgggcccacuccuccuccuccacacgcacucccggggcagcuuggguggggccuccugccagggccuccggggcgcugggcacgggcgacucuaagugcugcugggcuggugacagggagggcugaggaccugggugaggggaaaggggcguggucaccauccacccagucugcccggaggcgcccaggagcuacacugugcuuucuucuccacucagccauagaaauucccuuuuucccacucuuucccacaggcccuagaaaggggucuuacggaaguggcucuggggucaccuggauggucaauuacccauuaaagcucauaugaauguggaagucccucaacuuauccgaccuaaguaccccuauuuuaauacagggucaaaucuagccuguucuauuugacagacggggaaacugaggcuccacccauagaagugaccaaggucacacggggauaccgccacugaccccacccagucacuacccucaggucuccagcucacuccugcccaaccacagugaggccacacccccggauguggcauuggccugaugaccagaaggccaaacugggacuaacccaagaggacuaggguuugggugaggguggcagggguacuggguuagacuuugugcuccacccccucuggcacucauccuugugccucgguccugucacacuagauccugagccucaguuuccauuaucucugaaccuaguccugaaacgcagggaaaguuggaaaguuuuucucucuucauggggaggugggggcaaauagaaagggaaacccagauggucauuccccguagccgggcaccacaggguuaacagcccaucaggcgagggaccuuuaacccuucccucccugagccucacccucuccccgagggggacuuucccaacacaauggccccucccccucuccuuccuccugggggacugcggacuaacccugccagugccaaagagauucaaauaaaaggguaaggccuccgaccccuccccaaaguccugaggugacaguccucccacuggccacacuccuucccacugcaauccucauggggguggggggcgcccagggacccgggcugggggaggggagcugagaaacagcuguugcccgaggcccgggaagggacguggacugcaacuccggggacugcagucagauucuaagagggacuucccacucgacuuggccccuccauccaugucucccacucugucuuccugguucuugcuacacaaagaccacacuggccacacccucccgguggccccacucagcuccacucccgcuucagcuuccccgggugcggggcgggcacucaccguccgggcgcgggccucugggccggcugcggugacccccaggccagcgggggccccccagggcggcggugacggcagguggagcggugggggcgcagagguaggcggccggcagcaaggcaggggcagcaggggcggcgggcaggccgggcucgcaaaggcugcaggauacagcggagggcaucaggcggccgagcgggaaggggcgcggacugucgcgggcuagacccucuacgggcuccggagagcugcccuccuggcgugcgcgggccauggcgcucccuggagccugcgggacacggcgggaggucaguggggcgacugcggggggggccugcaggaccccaccucgcagacacccugccuggaagucacucccacccaggaagggaugaccccagggacagccuggccgggacacauggugaggggcgcacagacugcgucugggguuuguagcaaaacccaccaggaaaacugccuacuacucucagggcuugggccagggagaacuuucucaacagagaagagcgcagaaggggugcuggggcucccaggauacacggugcugucagagaaccguguguguguguguguguguguguguguguguguguguguguguaaugggaagacaccagugaacucagagaaguguccaacuuuaccgccccucccgcucccccagugagguggcucacccagaaacacauggggacacagacaugcacacacagccauccagagcccuuucaacauauuuacaccagucucacacugacccgcugcugacaugccagcgcucacccgcccacaaugcagccgucacacacugaagcacaacagacucaagucuucaacguguuucucccgcauacacacagacaacccaaagacaccccccuuacuauuccuuagcacaugcaccaccaucaucucaaaacacaccugaaugugcacccccccccaacuuugagcuccugggacacaacagccacacauagacacaagucaucauauccagauacaucauccccccucgugugcggggcagccacaucgggaggcaccagccgcagcugguagaagccauagguccagccucuacucucagccccaauacaccacagccaacugucagccccagaaaacacacacacacacacacacacacacacacacagagcccagcagcacacacaccuaaugcagagacagaaaacacuggccucacgugacugcuauaaacacuacagagagagagcaccacaugacacauagccuggaucacagagacaaaccccucagacccaaaacucacucucaccccccccucucucuuucucacacacacacacacacacacacacacacacacacacacugcaugcagagagaggggcuggcacugaacccgcuagaucccccccacccccaaagcccuucaugcucagcgugccuugugugccuuuugcugcucagaagucacccagcgagcgaucaggcacuggguggcaucccaucccaaaagcuggguacagcagaugcuugucuuggagacacccagagacagcacgcgcgcgcgcgcauacacacacacacacacacacacacacacacacacacacacacgcagcgcacacuugggcgagaccccugcacagcaacacagcucacucaagcgacacacaaacacagcucaagugccccggucguccgcaccaccaccaccaacacuaccaggcaagcgacagauacagauccccuuuucaccccuuaagagcacacguauacaacucugguuugggggguggccacccacacccguaaacggacaggugcaccccaccccgcagacacgcgggcaaggacucacgcagacaccccuccgggugacaaacgccaacaucucgguguagggauacaaacucgggagccaaacacgagcacacacacccaggcgagacaccugcagauccacagccccgcacgcgcgguccccgccgccccuccgcugucacagcccccccccucgacgccgccacgugcgcccgccccgcccgcccagcgcgcgcggggccaauaaccggcuguugcuggggcgcagcccccgcccgcgggagccacagccuccgccgcccccugucgccgcccccggcgggcgcgcgcucuggguguggccgauccucggugccaccccccaccccaacccucccgcagugggacucgggggacucgagcgagcccggggccacgcuccucccaggucucacuagccaccagggggcgcgggcgagcccgaaccccauuguuuguaaacaaacccgccagaccgcuguggcaccugugcgcccagacagggcgcccugagucccaggugcuuccuucccgcccgccuggcccagccuuagucccagugaugaaagcuggggcacaagcugcgggaaugcaaggcgaccguccuaucggcccgugcaccccgucaccuccuccagggagcccuccgggccuugccgcucguaagcagcuucgggaaucggggugcucacucaccccgggggcaugaacacuccggagaaaggaggcgaugggguggcgggcgguugccuucuggagggcucgcccgccgaguggguugcuauugaggcaccuugcugcugcuccugcugcucuaacugcagugacugcugcugcuucuggagucuucguguccggaucaccgcugcugcugcuugcuugcuggugucgccgccgccuccugggcuccccgcucgcaug

SEQ ID NO: 12122 - RNA, 7351 nt, Mus musculus
auucauaagacuggagcggcuacgccggggacacgcggagccggggcuugcuggacuugacuacuggugacucuuucuuuuucuucuucuuggaggccgugaaaaauuuauauauauauauuuauauauauuuuuaaacuggagagaaaguuuuguggguuuccuuuuugcaagacucuuucuagaucguucuuccgauucguccggaggauagacuuucuuucugugggcuucuggaucgcgccccucugcucucccucauuucuugggacgcuucgacaggauuggaacugcaucugaagcgcacgcugcaccgcggcacugcccggcggguuucugggcggggagcgauccccgcgucgccccccgugaaaccgacagagccuggacuuucaggagguacagcggcggucugaaggggaucugggaucuugcagagggaacuugcaucgaaacuugggcaguucuccgaaccggagacuaagcuuccccgagcagcgcacuuuggagacguguccggucuacuccggacucgcaucucauuccacucggccauagccuuggcuucccggcgaccucagcguggucacaggggccccccugugcccagggaaauguuucaagcuuuucccggagacuacgacuccggcucccgguguagcucaucacccuccgccgagucucaguaccugucuucgguggacuccuucggcaguccacccaccgccgccgccucccagguaaguuuuagaucguaaagauucuacuuuagugguuggggggggggguguuucuuucaggcuaaaguguagauugagcauccucucaaauagagacgcgccaaaacccaggaucugggauugcaauaguucgguuugcacuuugguuuuuuguuguuugcaaacugcaaagaauggagugauguuugcaaaagguuauuugcgcggagcgcgggaaaggaaugcagcugggcaaacguuggcgaugcccggugcaaaguauauacccggugguuagcagaagcugagaacuuuuagccgaaagccggcucccuaagccgaagcuaggcaaguaggggaagaaaaagaaacaaaaaauuccagagaagcuuccaggagccuccuccucuucccucuuccuucaaaacgcggacugcaaguccgcagucacccuccacccagcaagaguuagggccucgaaccccggucacgcugccuccgccuccugcgcggagacguaacgggggacccgugcguaaaggcugacgcgcuggaauccuccgucugacgcggggcacgcacagcgcgcagcgcccccuccgcccgccccgccccugacgucccgggcacguucuauuuuggaacgccgaggccacguugcuaagggagggggcagcguggcuuugugauuggcugucgcggcgcgagcuuuagccaaucagcguucccuuccuauuuguagagcguagcucccuuccuugcuuuuugugguucuucccgugcugggggucuccaagagggagagcuaggggauucuugucgcgaucgggggacucguugucaccccaugggucugcgaggaccuuguguggaccugguccuguugucauaagcuagaggcuuuuggcugaguguuagcgccucuaagggggaacugaaggccucaucccuucuccaggcacacauauacgugcucccugagcucuagacacucaguccuuccgagguguucaaacacuagaugagcuagccuacggagaggcagccagguggucucuaaaaggucugccuucccuuaguucccagggcucugauuggccagggauucagcccuucccucgccacgcccccuagaguaguuaagccucuaggauuccacuugcgggaagggggggggggggcgugauggacgcuucuuggguucggggacgcagauccuaugucaccccauccccugcaagacagucugagagauucucgcugucacuuuucucugccuaucaguucacugaaaccugucagucucacuggggaagagacagacacucggaagggaugcucucaacucuuaggccggucccccaacaccguuggaacugggaucuccgccccugcgggagcccucaugcagugggggguguguuugugugugaguggaggagaggaaggcuugggcuaaggccucucccucucccucccucuguggugggggugggguguuuuggcuguaugugugugugaaugucuguggcuccaucccgggagguuugucaccagguucuguccagccuccucucccacccacccccccacaccuaagagucaccaacccggggugugauucaccacccgcuggaaccgugcaaccuuuccccgaggaagaaggaggagguagaaggcaguugaacagaaucucucauuaaccacugcgucacgguguaguggaaggguggguguuguggcuuuuugccugugacacacacauccacacccgcucacccugugcucacucacaggggucgguguguguuauguguguugggcgugugugugucgguggcuuuguuugugugucuacgccuguguguguaugucucaccccguaggagugcgccggucucggggaaaugcccggcuccuucgugccaacggucaccgcaaucacaaccagccaggaucuucaguggcucgugcaacccacccucaucucuuccauggcccagucccaggggcagccacuggccucccagccuccagcuguugacccuuaugacaugccaggaaccagcuacucaaccccaggccugagugccuacagcacuggcggggcaagcggaaguggugggccuucaaccagcacaaccaccaguggaccugugucugcccguccagccagagccaggccuagaagaccccgagaagagacaguaaguaugaggccucaggaguugggauggaggagccuagcuagggaugugggcucaguuuguacagugcuugcugccaugcaugaagaucccuagcacagcauaagccaggagugguuaugcagaccuguaaccccagcucucagaagguggaggcaggaggagcaggaguucgaggccagccugugcuacuuauggaguccagccugcacugcaagagaucauuauuuucaaaaguuggccuuggggggaggugggugagggaaguaagagaaagugacaguaauuuugucacuuaauaguuggagguuccucugaggccucaagucugaaggaacuuuaccauucuggccagugaggaguagggguuauuauuugggguucaggaggaaggaguuuucuuagggcugauagagguacccccagaucucaugguccuuaucucugacucagcuuaccccagaagaagaagaaaagcgaaggguucgcagagagcggaacaagcuggcugcagcuaagugcaggaaccgucggagggagcugacagaucgacuucaggcgguaaggaggagucugggggugucuugaggccgugcugggagcacucugccuuguucuucccccguuucucacugugccuguguccuaaacgaggaaacccccucuuagggaacaggggucaguauaggcugauggaguggcuccauaugcaugcucagacccaugcccacuuacuuucgacuguuccccacuuucccugaauauguccccacaugucacccuccuggcuuucucucagccuaaggagacaagcuagaggagguaauucucucaccuucuuuccuucacuaaauaauaauccauuuugccuuccugccuccauuuuuuuuuccugagcuggggaucuaccuguguaguucagcccuccucccccaacuugauagccucaaguuucagcccuuggcugagaugccaucauccugacuggcucuggcuggaaacuauuuugugcuaagucaauuccuuaccugcuacuccagcuaucuacaguucugccgaacuugagcugguggcgcccaccaagcccacuucuuucucucuucuaccucagugcaaccccccacacacacaccucaugccugccccuugaaaccagggugugucucugauuucccgucgggaggcugaaggagauggguaacagaaccucauuaaaaacaacacauaagcauuaccuacugacucaacaaacuguaguguuuuucuuuuuuccucucaaaaaauuauuucguuuguuuauuuauuauuugcuuauguuugagugagugcuggugcaccacagcacacauacgaggucagagggaaauuuucauaguuuguucucuccuuccguguugugggugcuugcuggcaaucuccuucacucagugagcuacaaugcccccuucugcccuuuaaggcagaguacuccuuaguacagggggacccuuuccucggccucucaaaguugagauuacaaauguucaccaucacaccaggcuuggaguucuugccuaucagugacguccacuccugccuagcuucuucccaaccaucucuuagucugauggggaaaccgaggcacgaguagcauggucuaccaggauuuccucuuaggggacgguccccucaguugggagggagcuguccagcccccuggaucagcagcaagaauguaugagugugggguugggcgggugaagcuacucuguguggucgcugaccagcaauucuccuuucucugucuccuaugaccuggcccugcugggauccauuaggaaacugaucagcuugaagaggaaaaggcagagcuggagucggagaucgccgagcugcaaaaagagaaggaacgccuggaguuuguccugguggcccacaaaccgggcugcaagauccccuacgaagaggggccggggccaggcccgcuggccgaggugagagauuugccagggucaacauccgcuaaggaagacggcuucggcuggcugcugccgcccccuccaccaccgccccugcccuuccagagcagccgagacgcaccccccaaccugacggcuucucucuuuacacacagugaaguucaaguccucggcgaccccuuccccguuguuagcccuucguacacuuccucguuuguccucaccugcccggaggucuccgcguucgccggcgcccaacgcaccagcggcagcgagcagccguccgacccgcugaacucgcccucccuucuugcucuguaaacucuuuagacaaacaaaacaaacaaacccgcaaggaacaaggaggaggaagaugaggaggagaggggaggaagcaguccggggguguguguguggacccuuugacucuucugucugaccaccugccgccucugccaucggacaugacggaaggaccuccuuuguguuuugugcuccgucucugguuuucugugccccggcgagaccggagagcuggugacuuuggggacaggggguggggcggggauggacaccccuccugcauaucuuuguccuguuacuucaacccaacuucuggggauagauggcuggcuggguggguaggguggggugcaacgcccaccuuuggcgucuugcgugaggcuggaggggaaagggugcugaguguggggugcaggguggguugaggucgagcuggcaugcaccuccagagagacccaacgaggaaaugacagcaccguccuguccuucuuuucccccacccacccauccacccucaagggugcagggugaccaagauagcucuguuuugcucccucgggccuuagcugauuaacuuaacauuuccaagagguuacaaccuccuccuggacgaauugagcccccgacugagggaagucgaugcccccuuugggagucugcuaaccccacuucccgcugauuccaaaaugugaaccccuaucugacugcucagucuuucccuccugggaaaacuggcucagguuggauuuuuuuccucgucugcuacagagcccccucccaacucaggcccgcucccaccccugugcaguauuaugcuaugucccucucacccucacccccaccccaggcgcccuuggccguccucguugggccuuacugguuuugggcagcagggggcgcugcgacgcccaucuugcuggagcgcuuuauacugugaaugaguggucggauugcugggugcgccggaugggauugacccccagcccuccaaaacuuucccugggccuccccuucuuccacuugcuuccucccuccccuugacagggaguuagacucgaaaggaugaccacgacgcaucccgguggccuucuugcucaggccccagacuuuuucucuuuaaguccuucgccuuccccagccuaggacgccaacuucuccccacccugggagccccgcauccucucacagaggucgaggcaauuuucagagaaguuuucagggcugaggcuuuggcuccccuauccucgauauuugaauccccaaauauuuuuggacuagcauacuuaagagggggcugaguucccacuaucccacuccauccaauuccuucagucccaaagacgaguucugucccuucccuccagcuuucaccucgugagaaucccacgagucagauuucuauuuuuuaauauuggggagaugggcccuaccgcccgucccccgugcugcauggaacauuccauacccuguccugggcccuagguuccaaaccuaaucccaaaccccacccccagcuauuuaucccuuuccugguucccaaaaagcacuuauaucuauuauguauaaauaaauauauuauauaugagugugcgugugugugcgugugcgugcgugcgugcgugcgugcgagcuuccuuguuuucaagugugcuguggaguucaaaaucgcuucuggggauuugagucagacuuucuggcugucccuuuuugucacuuuuuuguuguugucucggcuccucuggcuguuggagacagucccggccucucccuuuauccuuucucaagucugucucgcucagaccacuuccaacaugucuccacucucaaugacucugaucuccggucugucuguuaauucuggauuugucggggacaugcaauuuuacuucuguaaguaagugugacugggugguagauuuuuuacaaucuauaucguugagaauucuggguggaaaugucugaucaggagaagggccugccacugccgaccacaauucauugacuccauagcccucacccaggcuguauuugugauuuuuuucauuuuguuuuuuuguauuuugcaccugaccccgggggugcuggggcagucuagcacugggcagcuccccucccccccuugguucugcacugucgccaauaaaaagcuuuuaaaaaacuguau

SEQ ID NO: 12123 - RNA, 14295 nt, Mus musculus
auaugauacaaaaauaguuuauuacaaaagaaaucugacccaaaccuaauaauuuacacugugaucaaugcccucccagaccccucuguuucucugggucccucaggguggaggguggcagaggagaggcuggcuguccuuugguuccuccacucaaagaauugaguaucugguggauuccagacagggaaccugggugccugagauuaagugggggcugagaguccugggcaaggggcgcgauugggaggaucugugcucaguaguaugugcaugugccuuggugcaaaaccuggucccgaggauugggcggggggaagcagaacaagguccucacaguuuccagaagagugguccccacagggcagggaggccccuccucaugaguccgggucugcccccccauccgucucagcugcuuccuggagcuggggaaggggguacgggccggccagggccucggaggacuccugggaagggcaggaaggcagguguagauguugugggaaggaaaaaguuuuggggagucgcggggaagccaggagcaucuuucgggggagacagcgagggugaggagcuuggcgaggacuggaggccuguggagggagaccaggguuagggcagggagaagccugcugagcugcucuaggguccccaaggcucccaguugcagacucucaccauuggagcugagacgacugcugcucucgggggaguugguggcacuuuggucuggggauggcucaggcugugacccugaagcagcccgagaggccuucccccuuaagauaucaaugaccugugggaaaaugaaggucaccccaaggccauugcgaccuuuauucauucuuucuuccccuuucuucccucccucgaccaaagugucccggugaggauguguagacacuuccuuugcuuugugacucaguuucuccucacagccucccuuccgggcacuuuuguuaccuugccggccuaagcucacugacccuccccaggccugcguacauccggggccgggcccagugcucucacccugcggcugcgcgccaccaugagaggugugucauugugacaguucuugaggccgcugucagccccgcugcgcaccagcgugcgcaccagaggcagaagcccgcggccagacgcagaaugcagagccgagcugccagaauacaucugagcguucacguuggcgccgugcugugggacggagaaauucgagucaagagucacgugggccaauggccucgcuuggccuggcgucagcuaggugaaggggacggacaggugaucacaacuagggcucauuccgacagcuagaaccugaaaugauucuggacauggggcugugucaaaaaugacguaggucuguaauccuagcacuuggagagugaaugcaugaagaucaggaggucaagguuaaccugagcuaaaaaguguguugaaaugccuuggcuacaugggacuccaaggagggaagcuaggagaaaucggcccucuccuagucucuaggagagacugugguccaguuaugcaagggaggaaaaggucugugacuccagaugguauagauggaauuagggcagaaggacagaggacauggugaaagacagaggcaggguuaguauggcaucccaaagcgaagccuaggcuggcagggcaacaggaauggacaaauuggcaucccaggaagugaaauaaaagacuugaaaaccagccaugcgugcugauagauggcucaucagguaaaggggccugcugucaggacugaccugagcuccauccccagggcucacaugauggaaggagaggacuucugaugcccacacacugcccucugaccuccacaauauagccaaccaaaucugauuuuuaaaacaguccagguaugguggcauaccccuucaaucccaaacacuugggaagcagaggcaggaagaucucugaguuaaaggcuagccuggucuacauaaugaguuaugggacagccagggcucuguagugggacucuaucucaaaaacaaaacgaaacaucccccaaagccccccaaauuaaaaaaaaaagucuugagggauaaagagauggcucauugguuaagagcacugguuggucuuccagaaaaacggcguuugaauuccagcauucacauggcagcuuacaaacguuugugauuccaguucuagggacucugaugcucucuuuuggccucagaggacacuggagguaccgggugcacagacuuauaugcaggcaaaacacccacguauaaucaaaaaagaaagcuggguggugguggugcacacuguuaagcccaguacuugggaggcagaggcagaggcagguggaucucugaguuagaggccagccugggcuaugaagcgaguuggauugcacgcuagucaacucuauagaguaagacccuuucacaaacaaacaaacuuggaguugcaaaugagauacugaagagaagaauccgagucagaggcagaacagcaaccaggguuugaauuggaaaaugggguccaugccaggaguagaagugacaagauggauuggcgccagacauggaagaagccaaagauggguacuaaccagcagcaggaguugcaccauguucaggcuguuguucuccacggcguggaugaguggggagcggccgcucuugauauccugcgagaggacagguguuucagucucucucugaaggcucugagcaucccucccucugguccagccuccagcgccuuaacuacgugaacauuucugccacccuggcgcccuucgcuagcuccgccuccugagccacaccuccacgcgccagaccacgccccucgccggcugccugguuggcucaccacugcaucgauguccgcgccacgcuccaggagcagcagaacagccuccuggcacccgguguucacggccacgugcagggcagugagcccuugaagaaggggaagccacagucagucaaaccccggcuugggcuugaauggugucaaccucaccuuguccccucuggggacucaccuucauaauugcgaaccuccagguccacggagccugagguugcgcuguccagcagggccugcaggcagcuggggcugcggugcucgcaugccaggugaauugcagucuggccgugacgauccagggccauggggcuggcaccagcugucaccaagagccggaccaugucugguaauguggugaugacagccagguggagcggggucuggggaauagugacagugagggaucagaguaaagcugugcucucaccucaggcuuuuugaaucuagggauagaagccuacgcgacaccucucccgauucaagagagucagagacucuuucgucuuccucagaacccaaaagucuaacuucaauaaagcuucuuuuucuuuucuguuuuuggauggggggaaauguugggagauaggaugucaaguagcccaugaugacuucagacuugcuauguagauaggauggaugacuucaaauuccugagaccaaaggagugagcugccacgcugguuuugguuuuguuugcuucgauuuuaaacauuuauuuacuuuauaugggugugugagcacgugugugccauaguacacuuguggagguugagggauaaguuguagugaguuucgaacucaggucaccaagcuuggcggcaagcaccuuuaccgguugagucaucucacugcccccacagguuguuuuuguuuguuuuuagacaccauuuugcuguaguauagcucaggcaagcucuccauugcucacguucaguucauguuuagucucccaaaugcugaaugacagcuguaugccaccaugcccagcuccacugcccucuugucccaggauguggaugcuggcuccccugcauccuuccucuggggaccccuccuucgcggugcccaacucccggccaccucaccugccgcagguuguuauggacgucuacuucgcggcucccaagcuugaaaaggcugaguauucgguagacagcggcuauguuauucuggaccacagcgauguggagaggccugaggggacgaugggacagucgcugggauuaggggcuggucacuggauuguugaaagucaugguggggugcuuuuggucauuuuuaaccaccugggaacagcccaaauucgcuuucuuggacauuaauuacagccccccaacuccugccucccagccccugagcucucuggcuucuauuugcccugucagacugucacaucaaagccagaggaacauuuucagauacaucuuccuccaacugcuaacuugaucacaggucccaugugaguuaguaaaaaacuggauaguguuugguuucaguggugcuaggaacaaaacccuucuacuggcuaagcaggggcucuagcacugagccacgcccccagccccucacugggggauucuaggcaggagcucuagcacugagccacaccccccagcccuucccugggggauucuaggcaggggcuguaccacugagccacgcccccagcccuucauugggggauucuaggcaaaagcucuaccacugagccacgcccuaguuuucacaggauuuuuuuuuccugacaggauuuuaguauauaacacaggcugucccugaucucacucaaugucccaggcuguccucaacucugugauaauccuccugucuccugauuacaggcuugacaucacaagugugagugagugugggucuacguauguagcucagaguggcuucaaauugucaauucuccugccuccgccuugcaaggcuaagucaucuugucuuccucuuccauuuccuuugacagcaucucuccacacucucucuuccuucugcucugaacacauuggccuccuugcaccuaagacauaccagccacacuuacuuccugggaccuuuuuguagguucuucagugugcccggaacagguuccuuagauaucuauagggcuuaccacccucaucccugccucugcugagguacuauggcagacccacaugccuucuccuuucgucuaccauaguugcuuccagguugcucugugguucauugucaaguuugucaccauuuucuuccugaaucuccccaucaaaauaaugucggccccacugggcagaugccguucccuguccagagcuuaggaggcucugacagagaacaagugugcugugacuaugugcugaugacagguaucuaucccauaugucacccugagugcuucgugacuacuuccccagccuccccggggccauagcuuccuuaucugugaagugaggcaugcaaacucguggucaggucucugccucauaucagguucagccuuccagggcugucuguggaagggccagguauggugggucccaugcuguuuguuuuuccagacaggguuucucagugaggccuggcuagccuugaacucacagacagccaccugccucugccugggauuaaagucaugugacaccacugcccaccuggugacucacacuuuuaaaccuagcuguccugaggcagaggaaggagguucucuguguuugacacugcccuggccuaccuagugagcuccaaccagacagggcugcggagugagagcuaucucagaagaauaaaauaaggaggaaggaaccaugugggaagugggucauggcucuggagcuggguuuggcaguuuagaauguccuuauagcgugaaggauccacaccccagcuccuugaggccuuccuuuacauacagcauggcaguuaucuuuacuggagagagcuacucacccaaugaugccuagaggugaucacuguuccaauuucccaaucccucaucuagggaggccacauugcuccaccauuuccuguggggcaccugaagcccucuucagaucccucagcgacauccccacuaaagcaccugcucucuuuccagggaucccagacuagaauaaccauucccagcugagggcaaacagaaggaucacauauguacguggggacagggggagacaggcuggccgcaugcucucaugccuccuggccuuuguuuuucauauuugugaguguggugcacacgugagcauguguccugugugugucacugucuucccucaagcucuccacucuacuuuuaaacuuuuauuuauuucugcuaaaaccagaucuugguuugaccgauagcauggaacucgcuccagagaccaggcuggccuugaacucagauccaccugccucugccacacggggacugggauuaaauguguccaccacugauaccuagcuuuguuucuuugcuauccguucaagcauguguguaugcaauuacugugugugcauuuuuuucgacagaacauguguggaggucagaggucaguucugucuucccccaccauguugguauuggggaucaaacucaaguugucaggcuugcauacagauagauccucugcucucuaaaccaucucaccaaccccuccaccauaguguuuucaugauuucccuguuuccccccugugugugucuuugcacaucugugugcacacaugucuuuacacuugugcgagcgcacacuugagcucacagauguguguugacaucagaaacgaucccccaucacucuuccacccuauuuuuugaggcaggaucucucauuggacggagcucccugacuagugagucuccaggcucuuccugccuuucccuuccagaggugagauucauccccagcuuuucacugcaggugcugugguuccagcucuaucuauacacuugagcagcaaugcaauucaggcuucuguguuuacucucuuaguuagcuucuaacuacauagacacgcauaacgacccaccgaacacccacccauugaacugucaaucagcccugaaugaccuucauuuagucucuuuacuacccaaucacaguggcuguacaucugaaaggaggauguggagcuugaagcuagcuugggguacguagagagauucuauuaacaaaacaaugcuucuggagcagggccgugauagcaucuuuaaucccagaauuugggaggcagagacagguggaucucugaguccaaggccaaccuggucuacagaaggaguuccaggacagcagagaaaccuugucucaaaaaacaauacagucuuuagauucaguacaaugacagcaccugccuagaaucccucagugaggggcuggggguguggcucagugguacagccccugccuagaaucccccagugagggucuggggguguggcuuacugguagagccccuccuagaaucccccccaagagggucuggggguguggcuuaguggcagagccccugccuagaaucccccagugaggggcugggggcguggcucagugguagauucccugcgcagaaucuaggcuaggaaauacaaagcucuaggcuucauucuaaucuauacgcacgcacgcacacacauacacacugcaaguucauuaauggagcaucuacuuucucaccugccagcugccucuuacuaaccggauucuugccaaggcagacagguacagugagcauucagaaucuacagaucaccuccccacauuauucugaggaagugcugaaaugucgcgguccaauaggcuugggugaggggguggguggaucauacugccagaaaugcaaacggucccuaggagggcccgggacaaaguaccuccugcuugaguuugguuuuccuuccuacaauagcgccuauggccggaacagauuacagugggcgaauuccugagucuaaaucccgaugguugaaagcagauggaaauagaaaaugcuggggggaggggcgggcccugagucccuccgcguuuggcuucucugaagagggaugcagcaucuccuuagaagcgucacccgcuuggcucccucccggcgcgggcgggguuaagcgagggcagagggagcgaaugauuucagagaaaccguccaggcuucaguucccauaaacgcgcgggccgcaggggguggggcggggcuggaggaaguggggacgggaggggcggcccagcccucggacuuccaguaacaggucuguggggcggggcugggcuuccugcucccgggggagggaagccuggccagucggggaucuacccggucaaccccuggcauccaaacuuccacucuuccaaugggggagaagggaggcagaaccccaaguccucaagccuggggcagcuucauuggguccagccuucagcugguuucuggucccccuauccuggcauccguaccgagggcuuucuuggaaucucagaaaaacauugucguaagucaacuaggaccccaaguggucccucuccuauguuccuuggagggcccaggaauacaacgccccaaucuuuauuucagguccucaggcacaggcggcuucacauuauuacagcgcguccgggcuguuuguaaaguuugcuugcuuucgggagcauagaggcuauuaagugagggccaagaccccugagccaccaccccaccccugguuuagccugcuauucuguuuugaaauucuguacuuuucuuuaaaaugcauggaaccacucccguuuuguuuuaagacugggucgccacccuccagccucaguuucccuagugcugcaauuacagguacacacaccccauuucuuucccuauaucccuugaagauggagggaucccauacuccaguuccggccccgagaccuuaaggcacacaccccgcucgcucccuuugcagagauuugcaguuuccuauuccugaccucuggggguucuggauggccuugcucuggagcccaggcuagccuuccuccugagcuugcuggcaguauuauaagcuggagccacacaaugcuggcucuuucugagucuugcugcccuccacgcagucaaggcucgaccagaaucucugggaucuagacuugagguccccugcccagccucgcugccuuccccuccccuccuccagccugugugaaguggggcucguggcucaggcaagcuggggccaggcccgcugcccauuccgguaagccccagcggaagggguuaagguuggagggagcaccgggaggggcaggcugugaggaguggaggaugcugacgugggggaggcugagcagcugggcugcggucaaguugugcgggaagggauuuccccgaggcggcagcugaggcagaaguguuugcguugggggagagggaggaggggcugggacuggagacagcacucugcuuaccagaccacagacagcucagcccugaggacagauacaaauuaaacccucucagcuuuuagccccuggggugggaggcagauagaguugauugagcccuuuaaggacacuuucuccuucuugagccuacagccuccccagggcggcucuguucaaacaguaccuacucaaguauugagcgcuuacuguuugcccagcccuguucuguguaccuuguguauacaggguugugaaaggucuaugaccaggccugguuuccaaacagaaacugaggcuccacaacaaucaagccagcuauugagccuuucucuacacaaagggccuacugauuucuggcuagggcuuccagaccccucaaaccaauucucacacgaggguucuuuagaagucauuucagccaaaugcuaaucccagcauccaggacacugaggcagaaggauugcuaugaguuauaaguuggccugggcuacauggugaguuccaggccaaucugggcuacagagugagauccugucucaauuuaaaugaagaagcuggacauggugguacagguuugugaucucagcauugggagauauagaagcuggaucaaaguuguccuaggcuagguagugcguuucaggccagccugggcuacaugugaccuuuacacaacaaaacaaagcauuuuuuuuuuuuuaaaaaucucuucccagaaggugcauacuuaugauuccuguuuuuaacagagagggaaacugaggcacagaggaggaagaaacagccagcugagguucacgcccaccuugacugagcagcagcagucaacugcauggaauguucauucuaugcuccgcccaggccuaaacccuccccuggcucagcagauacccaagcaauaaaucagagaauugggaaauccaccaugagcaugaaggaaugacguggacuagaggagaaauuauccaagugugugugugugugagugugugugagagaguguaugagugugugugacugugugcaugugugugugugagaguaugugugugugcaugugugugugagagugugugaguguaugugugaguguguguguauguguguguaagucguggagaguggagcguccuguugugugaguccuaccucaaguuugugaaugcgagugugcacggacccugugagcucacccacuacacaggaacaacaaugaugcuaaacaacacucagguggcuucugcggggcugggcuggaaccugggccuccucugccugcuacucaagcaagcacucucaacuaugcugcauccccagccccuccuuuuguuuuucuaguccaggcuggcugugaacucaugaauucuucagucucuacccuuagccuccccagaacgaggcuuacggguaugcacagggcgcucuagcugaaguuuacuggacacaugauguacgacacaccagacucccuucucacaugugugugugugacaccuccacaaaaucagcagauaaaacaguucccagagcuggguguggcagcgcgcaccuuugauccuagcacucaggaggcagaugaaggcauaucuacgugaguuugaggcuagccugaccuacagaaugaguuucagacaaguuagggccacauagugagaucuugacucaaaaaugggauaggggcuagaaagcuggcucagugguuaggagcaaugagugcucuuccagaggacccauagaagcuuacagcaucuauaacuccauuucugggggcagggggacccaauggcuucuucuggccuccucaggcaccagggauacacacacagugcacagaagcucacagggacaagcacccauauaaauaacaguaaaagaagugaaaauaaagauauauaguuuuuguuuguuuguuuuucgagacagguuucucuguuuagcccuggcuguccuggaacucacucuguagaccagacuggacucgaaacucagaaaucugccugccuuugccucccaagugcugggauuaaaggcgugcaccaccacugcccaucuuauaguuuucauauuuggauuaugauacaaauucugagaggguggggguguggcuuccuguuagaacaagcacggagcaugcacaagguucaguuucccacccccacaaccaaaaagaaaacaagucacuguccccccaaagcaguuuuagccagugagugcucuuaagugcccauuguauguaaaaggaaaccaagugucagagacagagaguguugcucaguggcaguggcagugguggcagagccugauauccccuguccuggaggucugagcuccucccagacccugucacuuacgugucuccauccucauccacccgaguggccauggcaauaucagcugaaaggggguguuccauggggcauaucauggaguaggggugaguaggcagguucagcagcggaaaguggggggccaucgucgggguagaguaaaugggcaucaaagguccugguagagcaagacaagaggagaccugggugaagccaaacccacaggccuucguccaggggggucucucucuucaggucuuagcauccucccagauuccccauucucaaucuuauguagcccaggcugaccuugaacaucaaauacagcugaggauaaccuagaacccuugauuccuccugccugaaucuccucagugcuguccuguaucacuucaccuacuauuagauuuuuuuucuuuaaaaaauagagauuuauuuucaaaguuucuauguaugugugugugugucuguguauguuuuguguaccacauuugugcgugugcccacagaggccauuagagggcgccagauccucuuaaacuggaguuaacaagcagugguaaguccucacaacauggguucugggaucugaacucaagcccacuguaaaaacagugaauacuuuuaauggcugagccauauucccugucccaaccccccccccccccacuuuuuaaagaucuauuuuuagucacuacuuuuuaaggcuguauucacuuuuuuaaugcauaugaauguuuugccugaguguguaccacaugccugccugacccucucagaggccagaagagggcauugcauucucagaacugugagcugaaagauguggaugcuggaaacaagcucuaguccucugcaagagcuccagaggcuuuuaaccacuaaaccaccucuuuggcccccaucccuucuuugaaacguugugucacuauggagcccagacuggccucaaacucaaaaagauccuccugccucagcuucccaaaugcuaggauuacaggcaugcagcaccauguugacuaccccagguucuguuagcuucucagacuuggcccucaacacccaagauaauguucuuguucgugccccuccucccugcuccugcacccuccaucccucaccucuaaccuccaucccucaccucuagcccccaccccucaccucuaacccccaccccucaccucuaguccccaccccucaccucuaacccccaccccucaccucuagcccccaucccucaccucuagcccccaucccuuacccuaaccuucauuccuuauuccuauuccuuccuacaucacaucucuucucucacaaaugucugaccuccaucuacagaaaggacccuuaagggcagagagagcccugucaccacccagcaggggacuucaguuauaagauuacacugugaguaauuagcugaaggaauaaaugacaagcuaauaucuggguguaggggaucuggggaguuggggcugucagaaaacuuguccuuuagaacccuuuuggaugacaacguugggaagggucauugcacagauggggaaauggagggcaggguucucaucagauggagaaggucucuuguuacauaguguccuccugcuggagcaugauagguaguagcugaagaaccuggagggcccagagaccucagcagcgcugggguauuuagcagauaguaaugugccuacugcagguggaugucccuuccuggauauaaaaguugaagagaaagguauccgguuucuugcugucugaccagcucugggguucccuuucuaaaguccccccuucccagguccccgaaucccucuccuuggaccgaagcccuucaguuucuaaauuccuuguguucccucucuuagaacccucaguccccaagccugccccuagggccaccugacccagggacacuugugagugcucacaacuagccugcagaaugcagucacuaucgcccuaagaccucgguucccaggauuuuaaccuaccguaucagccuccuuggauccuggguccauuucuauucaucuccccauaucugcuuaccagaaccccaguuuccaagguccgagugacgauuauucauaguucugaacaucuggucucucccaaccagauauucugcgucucuggagugucuugggaucccauaucugcgacacuggacgcugucuucugacccccauuccccaaggccauuugacccuugggcaccugccugggugaacuucuuggcacgcccauggcugagcuccagggccucucaaccucuuuccuagcugucuuugggucaucaacuugcacccuggagucccagcuaccaggaaccccaacuauuuguguccuguguucugcugaccuuagguggcccccacccggcccugacuuucaugggggaggccacucacccugguaguaaagggccuccggccuggccacacagugggggggcccagggacaaccgggacgucgcagccgcugcgcagggcguccagggguccagcggggcugcgcgugguugcgggcucuggggacgcggggcgcagcgggcguuugcggaguggcagcgcggcgcccggggugcccuugggccgggugcgcagguccacgggccccucguccauggcccccgcggggcaucggggcaucgggccgcccggagacgccggggcgugcggcgagcucggcacgggaaggcggucucgccgggcagcgggacuuccccu

SEQ ID NO: 12124 - RNA, 17996 nt, Mus musculus
ccgccgccgccgccgcccuucgcgccccaggccgucccccuccuccucccgccgcggauccuccagacagccaggcccccggccggggcaggggggacgccccuucggggcacccccggcucugagccgcacucggagucggccuccgcugggagccggcaaaggagcagccgaggagccguccgaggccccagagucugagaccagccgccgccgcagggaggagggggaggaggagugggaggagggacgagcugguugagagaagaggaaaaaaguuuugagacuuuuccgcugcuacugcaagucagagacguggggacuucuuggcacugcgcugucucgcaaggaggcaggaccugaggacuccagacagcccugcucaccgucguggacacucgaucgcuacccggcguuccucagacgccccuauuccggaccagcccucgggagccacaaaccccgccucccgcgaagacuucaccccaaagcuggggcgcaccccuugcacgccgcccuccccccagccugccucuugagucccucgcaucccaggacccucucucccccgagaggcagaucucccucggaccugcuggcaguagcuccccuauuuaagaacacccacuuuuggaucucagagagcgcucaucucgauuuuuacccuggugguauacugagacaccuuggugucagagccucaccgcgacuccugcugcuuucucccucaaccucaaauuauucaggacuaucaccuaccuuuccuugggagaccccaccccacaagcccugcaggggcggggccuccgcaucccaccuuugccgaggguucccgcucuccgaagugccguggggcgccgccucccccaugccgcccucggggcugcggcuacugccgcuucugcucccacucccguggcuucuagugcugacgcccgggaggccagccgcgggacucuccaccugcaagaccaucgacauggagcuggugaaacggaagcgcaucgaagccauccguggccagauccuguccaaacuaaggcucgccagucccccaagccagggggagguaccgcccggcccgcugcccgaggcggugcucgcuuuguacaacagcacccgcgaccggguggcaggcgagagcgccgacccagagccggagcccgaagcggacuacuaugcuaaagaggucacccgcgugcuaaugguggaccgcaacaacggugagcuccgaggggccggggagccaggagggagcccccagggggcgccggagugcaggggucaccgggaggaaauuacccucagaggaaacuggcuggaggaaggggagcccugggggcaccgggacaacugugugggugucccaaagaggcuggcacuuucccguaccccaggugucuuugagaggaauagacagccugccaaagugauccucuccuagaaaagcaaggucguggggagaguccccucuagaagaggagcauuuggcagguuuuguuuuaaguuccccuaauggugccuaaaaaugcagggcucgcuggguggucucuuuccagaaagguagaacccagcucaagagaauggaagguguccaacauuucggaauggagaugcaauguggaaagccgaccccagaccgggucgugagauggagagaaaaccuaggggauggguacccuagaacugccaaauaaaaucucuagugggcuuacucucagaaagcgacaggcgcacgcuagagagugugaucuguggagucacuacgggguuacaagugaaaaaggaaagcgacguuguugggagaaggacucuagagaggagcagagagggugcggaaaaugagcccggaggugucacgaguguuuugcuugggggcguaaaagagcgcgcgagccggcaggcggagcccagugaaggaagcgagcgaguccucaagaaaucuagaauacugggucauugggaaggagucauaaaaaggggagacuggcuuaggaagguggccccccgcggcagccaggcagacggagcagggauaccaugccauccaggagugaguggcgagcgccccucuccugggcguggaagggaguggcugagccucuggagucgagcccuagaggagcagcuagaaguaggggagaggcagucuucaaaacucaaaugaaaaaaccgaaucgguaaggaugaggaagcccccacgugggugccacgcgcguggggaggagcuugcgcuucuuggggggguaagaggaccccacggaacugaacgcugacaggcuguaaccccaaggucccaguuccuccuaccggaggcuggggaaaacccagcguccggucgccacgcccuccucccuucccuuuccuucccgugcccgggaggaggggagacagagaucgcgcgcggagccuggggcgagacgaggcagguccggaucccgcccucccuaggcuguuagucucccgcccuccucaccccaguagugggcggggaaacucacggccccgcccuguaggcgcccacgcgggacccaagcgucgugugugaccggggaacuuuaggugucaguagcuucuccagguuucaccuuccuaaccccagagguggacuuaaggauuauuugcacauugcuggacccaauuguggcucaggccuaaugacaccccucccuagccacgacuuaaugugaccucuucguuggagaaguccuuuacucuccugagacuguauuucuuacgcauauaucucuuccggcaugugccucucauuuccgucuccucucccacauaccuauucaucucuaugucaccccauuucccucugcgacacccacaauccuuccugcccuccuaucucuccccuaucggcuacccccagcugagaucccaucccuccauugugguuugcugaguaacaaccgaaccaagaauagaggcccucuguccuucaucgacgucugggaucaccaucucauccccacuacaagaagccagaagccccagcagacgcagaauuucgggauuuugccccuucguuccccagugcagacauccuuuaggcuaggaagcccuuuagugaauggggcucccaaaccugcagucacucuuaccuagaaauccucuuugcugcuaacacgaccaggaaaugggcuaaagaggggaguaacuaaugacacugaugacaggcaaaugauaauaaacccccacuggccaggaaauggcagaguuuugggauuaggaccacugucugguugucuccaucugaucccccccuccccugcuuauccucauucccacucaguucucccccuccauccaccucccaugacuuacugacucgcugugcagggguggauugguacggggugcgggcuuccccuucucaggagaggagggggugagggaaggggaugugaggggggacuggaaggagggaaagcugaagucggguuauaaagugaaugaaugaaugaaugaaugaaugaacgaacgaacaaacaaauaaaugggggggggcaacccaaucccaggcugccaagucugucuaugacuguagucccaguacuggggagacaaaggcaaaaggacugcuucaagaccauccuuggauacacagugaaugugagacuagccuaagcuaugaaauccugucuccagaacaaaagaaaauaaacaaaaaaauuagucccuggggcgggagagauggcucagagguuaagagcacuggcugcucuuccagagguccugaguucaagucccagcaaccacaugguggcucacaaccaucugaaauaagauccgauuccuucuucuggugugucugaaaacagcgacaguguacucauauauauaaaauaaauaaauuaauuuuuaaaagcuuuuaaaaaauuagucccuguaauaagguggcuugaaucuuaccauguugugaagucucaaugccuuuaucuuuuguaaaguguuuaaaaugauaucuuuaccaugcacuguauuccccucaccuuuauuagcacacacacaugugcacacacacgcacgugcgugcacacacacacauauguaggcuaacucccagugaacagcuuccugacucaggcucaggcuccucagcuuuggcugcagacucacacuagcuaaaauacacuuuauuauguuuagcuuuuccccagugucucaucagcucuguuaauccuggauuugauuggugucuuacaguuaaagagagaaguuuggccgcuacugguggcacaggccuguaggauuugcugaaggaggcagaggugggaggaucuggaguucaaggccagccugggauacacauuuuucugccagccagugguggcgcacgccuuuaaucccagaauuugggaggcagaggcaggcggauuucugaauuugaagccaguuuggucuacagauugagcuccaggacagccagggcuacacagagaaauccugucucaaaaaaaaaagaaaagaaagaaagggagggagggagggagggagggagagaggggggagaggggaagggaaggaaggaagaaaagaaagaaagaaagaaagagagaaagagagagagaggaaggaagaaagaaaggaaggaagggagggagggagggagggaagaaggaaggaaggaaggaaggaaggaaggaaggaagggaggaagggaggaaggaaggaaggaagaagccacagguaacauaguguuucaguugcagccgccuaggcugggaaucagaacuuaaugguacuuauuucauccaagguuagaaggcaguuggcccaguaguagagcacuuccuuagaauccaccuccaaggggcuguguguagcucagcgaccaagcgagcgagcgcucccaccuagaaccugcugugggagucacucagugcacgagcacccaaccugaguagcagcagggaagcuuucugaucccccaaauuaugccgugcaauuuacucuacaacuucuguuugguuuuguuugaggcguggucuccugcagcccaggugaggucagccaguuaagaacauuagagaggggccucuaagagcagucaagauaaccagcuguucuuccagcggguugggguuuccaggaccuacauggcagcucacagccaucuguaacuccgguucuagaggaucugacacccucuucuggcuuccacgggcacuaggcaugcacucugcacacagacacacggaugcagccaaaacaucccuacacauaaguaaacugaauguuagaaugugaaguggaaugccaaccugaguuagagcccaugggcucagaagcagggugucucuguuucuuccauccuugucacagaccugaccugaugucuuccuccuucugcuccuccccacccagccaucuaugagaaaaccaaagacaucucacacaguauauauauguucuucaauacgucagacauucgggaagcagugcccgaacccccauugcugucccgugcagagcugcgcuugcagagauuaaaaucaaguguggagcaacauguggaacucuaccagguaaggcuuugagccugagagguggcacacaggucagcccugcugagguguggccagguggcucaguuugaaggcuccuggguacagagccaggccugaggguagagcacagugucgaagccuaagguuuuuauuuuuauuuuugucuuguuuucaauugguugguugguugguuggguuuuucgugacagggucucucuguguagcccuggcuguccuggaacucacucuguagaucaggccggccucaaguucacagagauucgcuugccuuugccucuccagugcugggauuaaaggugugugccaccaucacccagagaauccuaagguuuuuuuaaaaaccgcucagauugcauccuauuaguugaauuugggaguuugaacuguaaaaaugcagaaagagccagggauggauaucuggcuauguaugcaugacuagaaucccccagugaggggcagggggcguggcucagugggagagccccugccuagaaucccccagugaggggcugggggcguggcucagugguagagccccugccuagaaucccccagugaggggcugggggcguggcucagugauagacugccuagcuaccacuaaaaaugcauuagguucuguccucagcacagaggugaaaaaaguaacagugaggaagaaaaagaaguuggagucuuuaggagcagacacuugcaaauccuagcacgugggacgggggaggcaggagaucaggagucugaggccagccuggacuacaugagaccuugucuggaggcugaggcaauaagaucucuuaaacccaagcauucaaguccagcacaggcagacuagugagaucuugucucagacagagaaauuaagcauuucuuguagucucuuaaaucagcagucaaaugcauuuuuuuuuuuuuuuugacaagaguucccuguguaguucuggcugucuuggaacucagagcuccacucaccucugucuucugaguauugggauuaaagaugugucagccaaaaauuuuucaacccgggaggcagaggcaggaggaucucuugaguucaaggcaagccgagucugcagaguuagugccagaacagcuauggcuacauagagagacccugucucaaaaaaauaacaaaaguaacaaaaauuuaaaaaaaaaaaauugggaagacuguucuguguguguacucauaauaauaauuauaaguaaaauaacaaacuauaaauaaauaagaaaauuacucccaaacucaggguaauaaaacugcugaacugugcacaauaguaugagcaaugaccacuugcauugugaguccucccugcugccauguugcagcagcauuauugagacccggcaaggccagcaagugcccauagcuugcacaguaccucaugcacagcugaggagccucaugggaccugaccacagccuggguuguccuccuugucccauguccuauuccagucugucuccaccccuccuccccugccccuggcugcuuucuguucuugggggcuguaugugagaguguggccugcagggcucauaugugucagaagccagugucuggggcuggucuggaagccaguuugugagacaggcagcaugggguuacagccagauuaucugggggcaagauggcagcgaccauacuccucuuugcucucuuuguuuccauuuagaaauauagcaacaauuccuggcguuaccuugguaaccggcugcugacccccacugauacgccugaguggcugucuuuugacgucacuggaguuguacggcaguggcugaaccaaggaggugagauugcuugucuuugugccauccuccaguggggccacuccuccaguggggccacuccugcuuguccuggcgucaaccugccuagcacuguguuccccaccccccaccucaccccugccacacacaugcacucgauagugaugucaagaaguaguacuccagccaggcagugguggcacacgccuuuaaucccagcacuugggaggcagaggcaggcagauuucugaguucaaggccagcuuggucuacagagugaguuccaggacaaccagggguaaacccugccucgaaacaaacaaacaaacaaaacccaaaacaaaaaaagggucaaucuguagagggaugcuugggauagguggugacccaaacagucccuguccuugcccucaguagaccucauaguccuuugguaguugaaggaggaguugacuucuagcuaggugcuuuaugaauagugaggaaugggguugaguacucaagaggugccugacuacugucuggauucaaggagggcuuccuggaggagagggcaucugagguaaugucucugagaugaauaaaggcaagaaggaaaaggagaugcaggagcacccuguaucaaguacccuguaucugcagccagggagauccugacauguccaucugucuaggagugaacaauuuuccuugucucuuaugggucccacaguaucuuuccagauacugguaaggucuugucggagcucuagcaggcaguaauggccgauaacgaugaaggggagaccuauacagagggggcaggauuuagaugagggaagccaaaggugcuguggaaacccaggcaagguuaggaucuuggagggcuuccuggaugagaaugugaagagacucaugggaaguguaguuuagccacauggagggugagucuugagugggcuggcaccaggaggaauguggaaggccacuggacggagguggagaaggguuuugucugguauacagucggcgcuuagacaguauuauuauguguccacucaaggaacaucucccuugagccagugagauggcucagcagguaaaggcaccugcugcugugcuuaacgaccugaguucaagcccaggacccauaugguagaaggagggagccauucugaccuccuugcccaccuuggcccaugugcacccccguaaauaaugaggagaagaugccagcuuagguuuuccuggugccuuuggcuauggcuucuucuguggcccuggccaagccgcuuucucuuggggugacuuggaguuaaaggaguuugaagaucaauggcguuaacacaguuuagaucagugacgggcaucuguguuagcguugaacauccugcgacaccaacacugcucguggcccuugacaccugggucacaauagauguuuauuguuaugaucgaggcccaggcucuacagagcacagagauaacaagaacccagggcagcaugcacgaugguacacaaaccagcggagcccugcgcuugugaggcagaggcaaggggaccacgaguucaaggucauucuuagcuccauagugaguugaaaauuugaggccagcuugggcuaccugagaccuugucucaaaagcaaaagagggcuguggcgagggcucaggggcaggagcaucugucucgaaggcgcgagcgaggaccugaguucuugucccuggcacucagguaacaagucaggcauugucauagugugugcccguaaucccagccuuguugggaguuccacguguguauggagacaggcugacacacggcucuaugaccugcuagccuggccaaaggacugggcucaaguucagagcccaggcaauaagggagaaaggaauagaggaagacacuuguuacccagcuauaagccuccucauguaccauacacagaacacaucacccauacauauucucugauauacauaaaauaugcauuauauauacacacauaaauauauauauauacauauacauacacacacauauauauacauauauauguacauauauacaauuuuaaaaauuacaaaaugaaaggaaauaaggcaggauacuccccugugcauguuuuccuuuuuuggguuuauuuguuuguuuguuuguuuuuguuuuuguuuuguuuuguuuuguuuuugagacaggguuucucuguagcccuggcuguccuggaacucacucuguagaccaggcuggccucaaacucagaaauccgccugccuuugccucccaagugcugggauuaaaggcgugcgccaccaccgcccagcuauguuuuucuacugagaccaaagaaguaaauauucaugcagaggugucagagccccugcuugccguggagaaagggaacagaugccacauuuggagaaggacgugucucuuucagagccuuucccgagggguugauguuugagcugagcccugaauaaggggagaaggguccagcaauucaaagaauaggagcaagaaugaaguguggggugacuagccgggagcccccaaggcuggcaguuuccuguccccucuucccccucauauccucagacucccuuccucucccgcagacggaauacagggcuuucgauucagcgcucacugcucuugugacagcaaagauaacaaacuccacguggaaaucaacggugagcuaacuucccggguccauccugacacaggccccucauggucugugugcacgugcaugugugugaaaucucacccaucccucuaaguguguguauguccuucaccacaacauccaaacccaacagggaucagccccaaacgucggggcgaccugggcaccauccaugacaugaaccggcccuuccugcuccucauggccaccccccuggaaagggcccagcaccugcacagcucacggcaccggagagcccuggauaccaacuauugcuucagguaaacacugucucucuccgaggcugugcaggcugcgggcugacugcagccuguggacuggugugccaccauguaugccugcagggcuuggggacaaguuccugguucugugggcagcugagaguccuagaaugagggguguuuucuuccuggagugcugggaucagggaauucaacaagaguuggaagucuguuggaagguugucugguuggguuuuaaaauucuugccaggcuucugccacuuugggaugcuaaugaaagaauuuacugugagccauggagcguguugaccccaggaaagcuggagugcugggauccaaacauuuggguuccgaaucagaagguggucugcacuggguucccacacucuuggcagaugguggucuccagugcugguggaugagagcggcaaauccugggucucagaauggcagggcuggcagggagauguuagcaucuagaguggagguggagaaagccagaaagugaguuuccugagggccagcgcuuuaucuggcaguggugcacccugaggaggugagaagauagaacuucugagauguauguaggcuuggaagugugaaguguuggaauauaguacugagauagggaacucugaggagacaagaucucucagagucagagagugggcguccuaguguauccagaaugcccguaccaagggccaaagcuuuuuggucauuguuuuuaaguuauaucucuguguguguguagggccauugugugugugugucuguguguauguaggggcauccaugccacaaaacugugugacggucagaggacaacuguugggaguccguucuccuuccaccaugugagucccagauauaagacucaggucauugggccuggcugcgagcaccuuugccugcugagccaucuuguuaguucuccuuuguuugguuuuguucgagacagggcuuugcuguguaauccaggcuggccucagauucacuccuuuagcccagacugucuugaauucucuguccugggauuacagaugucacacaaccacccaguuccagaaugguagacucauauuaagccucgguacuguggaugagagaaagaaauuggaacguuagauccuagaaggcaugaaauucagggguguugagagaugagagcagugagcugaccuaucccuuaccugcuucagacuuuauagaguucuguguuacauaucgguccuuggcuggccggccuccuccuccuccuccuccuccuccuccuccuccuucuccuccuccuccuugucuucaccuuugguugucagccuucacauaggaucagauguccggucuucauacugcagguuacuaagagaugcaggaagcuauguaaacucuguuccucacauacugggaaacaaacucagggaaucaugaaaaucucuuugucugucugucugacugacugacugugucugucugccugucucucucuuauauuuguuuugccuaugccugauguauaugugggcucugggaauccgaaaccaggucuucaugcuugcacagcgagcacuuaauucccugagccaaguccccggcugugacaagcaaaauuuugcauggaagaacaccaugccaucgagcaaggccuaucagacacaucaaccaugaucugaugggaacuguagcuccaacucccauguugcagggaacugcaacagagggacagacuaacaacauuagccagcaccacagggacgcacccagcaaagugcagauggugggaaaccuagucauuucuucaacagauacagugcaaagaagggaggggaggauauauaguccacacuacuagaagagagaggaagagagggcugagagguuggaggaggaggaaagaaaaggaaagggaaaaagauguuuaugggacacagugggaaacaugaaccuugaguaguauuugauuuuagugauuuaauguuaaauuuuugccuggggaagggggcuggagagauggcucagugguuaaaagcacuggcugcuuuuccagaggacuugcguucaguucccaccacccauaauaaggaucacaccugucuauaauucuagcucuagaggauuugaugcccucacacaugcauaagugcagguaaaacaccaauauacauuaaaaaaaaaaacaaaacaaaacaaaacaaaaaaaccaacccucccuaggauuuuguuguugcugcugcugcauuugugauacugagaaaacccaguaccuuguacauaguaaagaagcacucuaccacugagccacgcccccagccccucacugggggauucuaggcaggggcucuaccaccaagccacgcccccagccccucacugggggauucuaggcaggggcucuaccaccaagccacgcccccagccccucacugggggauucuaggcaggggcucuaccacugauuuauauuuuauauugauuuauacuuuugauucauguuuaaauuguaaaauauuccucacuuucuaagagaaagugaacuuuucuacaaaaguucauuaaacaaaugaaaaaacuacaguggcggaaagaaaguagguggaaugaaauuggccacgagucagcaacuguugucauuuacaguuguggagaugcgaauuaguuaagaauccauaauucagaaguccaaaaucucgcuggccauggugagcaaggcuguaauccuagcgcuggaguaggaacgggaaccgcaggaggucaaagucauugauagguacgucguguguuuguggcaaccaaucagacccugccucgagaaaggggguggggcaucuggaaggaugaggagcacagcugcucuuucagagcacgcagauucauuucccagcaaccuacauggcugcucccagcaauccauagucccguuccagggaaucuaacgccuccuccuggcccccaugggcucugcacguaugugguguguguacacacauguucagagaaauacuccuacacauaaaacuuuuuuuuuuuuuuuuuccgagacaggguuucuuuguauagcccuggcuguccuggaacucacucuguagaccaggcuggccucgaacucagaaauucaccugccucugccgaccgagugcugggauuaaaggcgugugccaccacgcccggcucgcucucucucucucucucucucucucucccuuucuuucuuucuuucuuucuuucuuucuuucucucuuucuuucuuucuuucaaguugacagguguggugcaugucucugaucccagcauucaggaagcagaggcaggcagaucucugaguuugaggccagugacaaacaaauuucaggcaaauacauagauccugucucaagaaauaugaauaguaauaaaaauaaaauaaauauguaaagucuauguaaauauccccuuaccccaaaaagcuauacagucuagaauguuucuggucccuaacguuucugaaaagggguauuccguuuauauuguaacgcacugcuucugugucucuucacaauuuuccauggcaaagcuguuuuuaugccaucuuaaaaaccaccucccccgggguccucagggcuccucacagauuaggcccugcugggucucagacuggcaagggaggcuugaaaaagcagugacucugaaaacccugagaccgcgucccaguagggcgcccccaugugccaggcggugguggugcacgucuucaauuccagcacucaggaggcagaggcagguggaucucuaugagugcgaguccaaccaggcuuaaaacguccugccuggacuaggcuggcuucaaacuugcagcgauccucccauuucggcuucuugacuacaguugugcacagaggugcaugccugccugguucacaugugucaaguuuuauuuuuuauuauuuucuuuuacaugcauguuuugucuuuguggauguauacguggugcauauguggugcccaccgaggacaaaagaggauguuggauccccuagaucugggguuacaaguugguuuugagccuccauguuggugcuaggaauugaaucuggguccucugcaagagcauccagugcacuugaccucuaagccauuucccaguuccuugaccacauuuuagaguuauuuuuggugucaugaggaggaaccugcauuuuccuuccuugaauuacuuuguccugauucuaaaaauaaccccagccacugcuaagaauguggaaaauccagaaagucaucacacuggugaacguaaaacgccacugucagcauuuaguauacauccugccagccucuuuguuuguaauggaauuugaauuauacuauaccuguaucuuuacaucaugauucugauacaugucaggaacacagaggcucaaguguccuugcuggucagccugggcuacaaacugaauucugggucaaccuaggcuacguggugagaccuugucuuaacgcuccucucuuuugaggggaucauggagggugagguggcaauugcugguaaucccagcacuugggaggcuaaggcaggaguuaucagaaguucaagguuagccugggcuacauaacaaaacccagucuuaaaguaaaggacuggccagagacaggagggucuggggaguuugagggcagccugaucuucguagugaauacuaggacagccagggcuccauaaagagauuaucucuaguagaaauguuuaucaguuaauucauguacucaacauuugcugaacauguauacauuaagagacacuuucccauggagagaugaggacagauaauauuuaguacaaacaagcugaaucauuccgagacggaaaauaaaacuggugaaauggccagguuagaagccaggccaggaaaaaugaauauuagagcuugguguggugcacgcucgugaucccagcccuggagaggcagaggcaggaggaucaggaguuuuggguuggccuuggcuacaugaaagccugucucaaaaaagacaaauaaacacaagaaauccuggggaugaauuaauuuuucuguucugguuaaaauuguuuuaggguagaaauuccaaauguagacagaaaaagcaaagguauauaacccucuuccagcuuccagcauucucaggauuuugaugacucacuucagacacucuggagcuggagacuuggcccaacaguuaaaagcacuggcuguuuguucuuccuuaggaccuggguucaguucccagcacccauaugguuacuuagaaggacaaccaucacuaacuccaguuccuagggacuucaugcccucuucuggccuccuuggguacugcacaaacauggugcacaucaaaacuuacguaggcacacauaugcacacaaauaauaaaaugaauacauaaaccuuuaaaaccuagagcaaggggcuggagagauggcccagugguuaagagcaccgacugcucuucugaagguccugaguucaaaucccagcaaccacaugguggcucacaaccauccguaaugagaucugaugcccucuuauggugcaucugaagacagcuacaguguacuuagauauaauaacaaauaaaucuaaaaaaaaauccuuaaaaaacaacaacaacaacaaaaaaccuagagcaagccaggugguagugaucccaccuuuagugccagcacucagaaggcagagagacagguguauucuuaaguucgaggccagccuggucuacauacagagugaguucugggacagccugucucaaggaagcaaacaaacaacaccaaaagcuuuauagaaauucaguuucgccgggcaugccuuuaaucccagcacucgggaggcagaggcaggcgaauuucugaguucgaggccagccuggucuacaaagugagcuccaggaaaaccagggcuauacagagaaacccugucucgaaaaaaccaaaccaaaccaaaccaaccaaacaacaacaacaaacaaacaaacaaacaaaaaaaccaaaaaaaaaaaaaaagggaaaagaaauacaguuucuuguaguaauuguaguacugaauucccaggguggaauuuaacaauuguuuggagggagaguuuggaaggcaaguggaaagggcuggucagaggaggcacuguucauuuauguaacugauacuggacaccugcuucaagcaagauggcauuuuuaggaguuaaagcucccugggugguagaaaguaucucacauagcccaggcuagccucaaacucacuaugucuccaaggaggaccuggaacuucuaaucacccuugccugugccucccagguguugggaucgaaagugugagcccucuugccuggcuaugacugggucugaggacuagagaggaagcccauguggcugucagggugggcgagggaggacacugaggaaagccagauagacucauggugauaacaggcauuugacguaaacaggaggaaggagugaguagcuauggccuccaaaggcuuccaucuguccuguuugugccauucaggagcaccggcccuagccccauauucaguagagguuugguaaauauguguccuacaaauaggacgugcaggcacauguuggacugugaauuacuccuguguguucuguggggaugugacaggacuuauuacguccuccccgagagugcucaugggacuguugcuagcccugcacuggcucucaagugccugcccagugggaggugcuucacuggcagccuggaugguuguagugucacuauugucaucacaggcguccuggagagccugagcuggacaggaggcugagggcagccgagggcuggagcgggcugcaggguugucccugcuucugaccuuuguuccuccugccugcagcuccacagagaagaacugcugugugcggcagcuguacauugacuuuaggaaggaccuggguuggaaguggauccacgagcccaagggcuaccaugccaacuucugucugggacccugccccuauauuuggagccuggacacacaguacagcaaggugggucuggcucaugggacaggcuggagcagaggcuggggugguagggagagaaugggaagcuuagagcaguggggagucagcgggauagggugacagagaaacggagaagagcagggggggggugcagagcagagcuggagagauggaaagaaacagauugggugagaaaggcaagagagcuagugauguggagagauacagaaaaggagguggggagaauuggagaugggagaguaagugacugaggcagacaggaagaggagauaggaugaagagagagagagagagaggaagagagagagagagagaggccgagauggggacagaugagggacagagaacaauagggagagacauauauagaaauagacugggagagauagggaaacagagauggaaguugaggaggcucagagauaagagacagaaauguagagauccugguggggagagagauagggggagccccuguacucuggcagugaccccggcccacccgcagguccuugcccucuacaaccaacacaacccgggcgcuucggcgucaccgugcugcgugccgcaggcuuuggagccacugcccaucgucuacuacgugggucgcaagcccaagguggagcaguuguccaacaugauugugcgcuccugcaagugcagcugaagccccgccccgccccgccccucccggcaggcccggccccgcccccgccccgcc

SEQ ID NO: 12125 - RNA, 31270 nt, Mus musculus
auagugacugacaaaaguuuuaugugaucugagccucucuggaggcaccagaguccacacuucagaacaggcauaggggacuggcucaaggggcaacauggccccaaaugaggggagaugacccaucccuuggaggaaagcaggcauucccagugcaucgcacaggcuuaaggugggguguaccccacacaaggagaggaggagcauaggugcuuaaggagggaaaggacuuaggauggcuacaagcgcccacccuuggagucguaccuaauacucuagacuguggaccuuuagaaucucagacacucaaaacauuggcuccauagugcuuagagauuuaagaucuuuagacauauguauucuugggcauuuaauuaugugcuagaaaggcaaaaagcagcauagaaccuagagguguccagcauuagaagugguuagaacuuuggugucucauuaguccucguuaacuggagccucuugugacuuagaugcugaggacccacagcauccuacagggccugagacgaagaucaggccaacauuagaguuuuagaguuuaauaaucuggaauccugggagcagaugacguggaagcuuaggaaucuagaaccuuggacuaaacuuuagauuaucaccacaucauagcuuagaaacuccaucuggagacucuuaaagcuuuggaauuucagagucuagaaucauauuuccuugagauacaggauuuuuauauaaaagaaucuauggucauaaggcuucagaaucuguaguugaccaucacuggggucuuagaaauuaaaaaaaauaaaaguuugaaacauuaugaucuggaguauuccaacaugagcccuaaacuguuaaacuggagaagcaguaugccuuagaaccuucaugccuagaaucuuuagaauuuaaaaaucuacaaucuuccacugacaggaccccuggcuccagaaaaauaaagucuagaagccuuagguccuggaaucucagagucgugcaaccuaaaaccaugggagcauugccacgaauuauagagccagaaaaaucuagagccauagaaucucagagccuucgagcagugggccugucuauagcaacagcgcugcagaccuagaaacaagcaucucgguccaaagacucaucaucuuugagaacuuugaacucuaaacucaaaccuuaaaaucuagaacgcugggauggaagaugugagacgaucccuugaaacuguuauggauagggugcauaaggcauggacugcaucugagaagggagggaaggccauucugcaucuggggagaaggccuggagugacggagugggggggugagcuuucccccaguggcagugccuagcuuggguccugagaggaugucccagguggaagauugucucaggcuccguccuccugcccuggaggugcugggcagccucugucagcagacagaguggguccuggggcuguagaaggacaaaggacauagcguccagcugaguggacgucagcugcagugagacagcuacaggaauccuuaggaucagguuggguuggggggucagcuccuccagcagccccacgggguucaagguggcuuccgcccucauccauguugacauagaggauuucaucuggcuccugagcagggggcagagccuucaguguguucuccaagucuucccggagcuccgcaaaacuuggccggucucgaggguucaguucccagcaccgagacaucagggcauaccuaaugagggagagcaaagggggcagacugagcaggggcucagaggguagcaugcuagaaguuaaggggaggauuuagggcauucgggugagaaugagaaccugggagcuagagagagccucagcaacuuagggaugccuacagagauuugagaauugcaaaguuucugaggugggccagaagcucaggaacuaggaaggaucauagaaaaccucucugaguccugggugguuuuuaaugggaguuugcuagggcagagcuucccaguguggccacacagaacagacucuuguaccaaggccuggccuugaugcuguuuaccaagcacauuggggagggggcgaggcacaccuauggaaugaacuagaagucauaugauuuuccuauguccuugcguucuuugacacgccaccguucaaaagcugaggcuaaguccccuccugaguguagggauuugcuucuagcuuagcagaagacauggcgcacgugugacgucuaagacuaggucauaaaaggcagcgcagcuaccucuugcacauucucucggaucaucuuguaaggaagcucaagucgccccaugaagaggucucaucuguuuauuuguuuaugucaucauauagcccuggcuguccuggaacucgcucuguagaugagcuugaucucaaacucaagagaucugccugccucugccucugccucugccucugccucugccucugccucugccucugccucugccucugccucugccucugccucccggaugcugggaauaaaggugggugccaucauccccagaaugagcuugccacuuugaagucagcuuuccagccucagcguucacaugcauccccagcugcugccuugauaaccuugugacagaccugcagcagaaccacccuacugggcuacucucaggcugaucuucaggcaccaugaaacaaagguuggguuuaaaugauuagauuuuuggaguguagcagcucauacagcagcaaauaauaugcccuccccgaagacuucaauuuucucauuggcaagaauggggcuaaccacggugccugucuacuaacggugacugugggaucaaaugagucaauacaaguggaacacuguaucacugccuuccaggaaguucaguaaaagauuagcuauuaaucucauccucuucggcccgaggagcgcccaaaggaagcgugggggaucugaauccccccaccugacccaagcaacacccucuucuuaaccuuaaaguaugggcuaaaaaccacgccuuucucuacacucugugaugccgcaaagguuuccugcuagcgacucagggaucuaagucuggagaaggucaaugaagcagaguggggguuucugcacaggacccuggguguugaggcacaugggagguaagggaccaugggagguaggggucccaaggccagggcuacccaggaagguuguaugcaguugaucaucgcuuaagaauaccuggcugaggugggacgggguugacccagcuugccuuccacacagccaacagagaggaaaaagguuccuuuagcaaucucccaccccacuggcauucucagagcacuggugaggggcaaauggguuucuuaauauucugagggguuccaugcacauugagucagaacuugagauguuguugggggcucaguguguguaauugaggguuggauuaaauucugaggugggguuaaggagaguuuuaaagguccucacaggccguccagacaguccacaggcuguuucagccgauuuccuugacgcagguagucguaaaucucacuguucuccaccccuggauagggaguuuggccucggguggcgaucucccacauugucacaccgaaggaccacugucggaguagaggaagcggggugagaggaucucuccuacacaaggacaccuccaacaugaguuaagacaagcacucaacacuuacguggacauuugucgacagcggcaucuauggguguaucacaguaugcacagggagauuuugacacagguacacguacacacacacccacacacacacacccaguaacugacuuuguaggaugcagagguaugcacaccuguguacacauuugcaugaugucacaugucacccuucaugcccacauuguuguacacauccuauggcauacuuggucaccacugcuuccugaguacccaugcuguuaccacgcaaccauaagccuauuuauguccuagcccugcucacauauuauucauauauucuccaaacauguccuggccucacagacaacuuugcaaggaugcccacaggucccugugagcccuucagcuucuuaggccuugucgcccaugcugucaugauuacuugcuccuggccagggcacacauaccacaucgcucuugcugguguagacccgaucugccagacucucaauagcaauccacuugacuggcaucuuggcaaugcgcccuuggcgguaguaauccccguuguagaucuucuuggagagcccgaagucugccacacacacggacauguucucauucagccugccccgguugggaaaagcaguaaggucaggacauggcucaucuccaccaggaagccugcuggguccaccuccugccugaccccagaguccugcugaggguggagcucugacuccgaaacccuuaccccagucccagagggaaaugcuuugcuucuaguuccugcuacagugagucuggacaaaagggcuuccaaaagcuuucucagcuuuggcuuuuuaucaaucuugagaucuuuucgaaacuccagagucccuguucuguuuucuuggauuuaaaaaauguuuauuguuucaauuauguuuaggugugugccugccuguggguaugugcaugcgaguguggguacccauggagguccgaaguguagacucuccuuggggcuggaguuacaggaggccgaugcgaaccgaugugaaccgaugcuguggguucugggacaugaacuuggaaacaaacaaacaaacagccaggaaugaugguguguaccuauaauaucagcccuugggagacagagaaaaaagagucggaguugaaguucaucuuucacuauauaguaaguucagugccauccugggcuaggugagacccugucucaaaaaaaaaaaaaaaaaaaaaaucaaacuuuggaggcugcagagauggcucaguagcuaauugcacucguucuugcagagaacccgggcuugauucccagcacccacacagcagcucacaagugucuuuaacccuggugcccucuuuuggccuccuuggcacugcucacgcauaaugcagacauguagucaaaacauccaugcauauaaaauuaaaauaaaucuuuaaaaaaaaaaucaagccaaaccagacaaaacaaacaaaggacgaaaaaaaaaaaaaaaacuaacaaagaaaucaaacaaaaccuuacacaauguguguguguagaucagggagggcagagacaauaacuacacaagugcauccauauagacaguaucuauaucuuuuaaaaaguccaagaaaggccagguguggcugcacacaucuuuuacccuagcacuugggaggcaggggcaggaguaacucugugaguacaaggccagcuuggucuacaucgcaaguuucaggacagcccaggcuacacccaaauaaacaacaauaaagaccccaguguagggcuucucuagaaagccuuuccaaccaucuccuugcuggccuucucuggugcuuuggauauaaagugucaccccacaaaggggaacaguccccugaaggcuuaauccccagcgggugaugcucucccuugaugagcucacagcagagcggucaguacaaggagaugggggucuagcugcaggaagugggcacugggaagguuccucugauggcuauaugucucucucugcuuuccugcucccacgagguaagcagugauacaccgcuccgcucuaucucagucacgacgccacaccuucccaggaguccaccgcgauggugccaggugaccguggucuggaaucucugaaacccugagcccaaaucaaucuuuccucuucacuuguuucccucagguauuuugucacagucacaaaaaggugacuaccacaccuuucuaaccuugucuggagguccaacccucccaaaggcuccaguuucccuuucauccuggggguggggugggggguggggaagaagcuccuugcggaaggaggggcuuccagagggcuugccacucacaugcaguuccuggcagccaggucccgauguaugaaucucuugguacucagguacuccauaccacuggcaaugucggccaugaacuucacuagcaucugagugggcaggaacuggagggacaaggccaggagaaguggucagagucaaacaagggccuccuucccucccugugugugucuggaucuacucugguuuucauggcuuugagaacaucaacccuuuucuauagcuacaggguccuagaaaaccuacuccucucugauuugggcuauuucucuagccuuugauacccaucugagccaggaccccuuccuggguuucagacccugguccaugcuaagccuugguuaggaauuuguuuccugcuugcaucucgaaguaucuccccagucuccuucaaggucacccuuucagucaggccuucccuccaccccaauuaauuccaaggccaccuuaucguucuucucuccuucugcauuuucuucauagcacucacugcucuugcuuauuccuguuaacuuauuuauugccuuguccaccccugcaauacaggccccucgagagccagcuagaggucagccguagccuuccuucggcgccugcgcagcugcuaauuguucagugaauacucauggaccggaagaguagaugccucucaccacuggcugguccccgagccgggaguacaggaggaaacuguguaggucuccguguuucaugaaaggcaagaugaccacagguucugggaaacccucucugucagagcccugaaaacagacgccugagccccccaccccaggaagaucaguuauucuggcuaggcagaagaggggaacccaacuccgcucccagacagacucagccucccccuuucccacccccucaaaucuaaucuccacauuguuugggagguagaugguaaggaugaaacuucggagaggccauuucccagggauguuuccggagcccuccuggggacccucagcuauuucugggaacaggucaggggucgcauuccaaguugagggagcaaaagaaggggagcuugcugauccugaaggagaagcggguagggagccaggaagucugaucuuucugggcucugcgcugggccugggagaacaugcuccucccucaccaaugagccucaugacguugggguggucaaauuccuucaugcagacagcuucacucaggaaauccuccagcucugaucuugugcagauggcaacuuaggggagaaagggaggugagugacaaggguggaagggggagggaggaaggaggagggagaggauuucuucuucccuccuccuccagucuacugccauucuucacuaccaccaccaccaccaccaucaucaucaucaucauccaaauucaucaaauguuauuacuggaucuuaagauguccuacgcacuguuuuacuugcauaguuauuuuauccucaguaaguauaguacacauggugcuagcuugucugcuuguuuaugaaggccagaaagggaugcuugggaagacuuucuagagaagcccuacacuggucuugcaaaugcaaugcaguccccucgcugggagaguuuagacaagagcucuauuggugagcuguguucucaguuccuccauggcaaauucuaaccaagcauuuuacuacugagccaugcccccacccccucacugggggauucuaggcaggggcucuaccacugagccacacccccagccccucacuggaggauucuaggcaggggcucuaccacugagccacacccccagccccucacuggggggauucuaggcagggcucuaccacugagccacaccccagccccucacugggggauucuaggcaggggcucuaccacuaagccacacccccagccccucacugggggauucuaggcaggggcucuaccacugaggcacuugguuuuuuuuuuuuuuugaaacaaggaaguuuaugaguuggaagccaguuuuacacacauuaugcaaugucuuauaaugaaaaaaaaaagcaguagaaaguagcucagagggaggguauuugucugacauguacaagguucuggagucuccagaaucaacuuucgacaccccacccccacucacaggcacaaauacacacgugcgcaugcccacacacacauacacaugugugcacacacacaugcacaaacacacacacacacagcagcuuaaucuaguacacagaagaugcuuaguaaugaacacgcaaaugcauugacggcuccguagcucaggccccaaaacucaaaauucacacaacaucauugcucucugcccuccagcccuagccuaaccccgauaggcuuuccuuccuguaggaaaaggucuucuccuugauuccuuaugcuguuuaacuacugacuggccuuuacccucucugaugagauaguugcaauacauuaucaguaugcauuacaugccaccacuggcacuuggugcuuuguuuuauaauaguccuaagaaauagugacaucaugaauguuuuuuuccaaggaagaaaggaaggcuuggagagguaaagucagagcugauaaugcgaguggcuggcugugccucauucuguccugcccuccucaaaaagucauuuccaaguucccuuuccugcuagcgucuaucaguggcagacauuggugaaagagaagccaggauaucucacccucuuuccacuuccauugccuuggaacuguuacauguucaccagguuuuuuuuucuuuuucuuuuuuguuuuuguuucuuugagacaggguuuuucuguauagcccuggcuguccuggaacucacucuguagaccaggcuggucucgaacucagaaaucugccugccuuugcuucccaagugcugggauuaaaggugugugccaccaccgcccagcuguuugccagguuucuaacucuccccugggaagcccuugauucuguguucucagcuccuugcuggcuaugggcucugccuacagcuuccucccuuugcccuucagccuagagguggaagugacuuccuguuguugcuaaucuguuugucuugauguuucaguuauuauuaugcuaccccaaccuucauucaaugugacagcaaugucccuaaauucaacuccuauucgagugucuggcacaggcuccauuuucucgcugggaacacugguacuuuccggagcauagagaagaggcuuggguuagggaccggggcugcugcacauacucacuuuucauggucuucacagcgaccuugaggauggagucauccugauugagcugaccuuccaucacagcgccaaauucuccuggggcaggaagaagaaagacaucucagaggggucaguguugccugcaguuggcugagaacuagggagagaggaaucuuggcauuuugguggguuaugcgccuguauguguacaugugccuguguguguaugugugugugugugugugugugugugugccugugcacauucguggaggugugcuggaguaacucaccuucucccagggucuuccccaaggccaccuuaugccgaucuaccaugacgucucguaguuucuccuucagcucuucacugaugcccagacuguucacugagaugaggcagacggagccguguggcaggguugaugaucagguaaugugaaccaagaagggcagacccacugaugagucauugaacugugucuagagcacucaacccaucccaguuccuguagccucccaaugggcuccauagaagcaacuagccccagucucauuguaguggguacucuaacuggucagugcccucuacugcuuguuaaacauaguucuucagagucuggaguuuacccgcacaaagaaauggucuuucaagagauagaaagucuaauuagcuaaucacccagacuugauaacugcacacuauauacaaguaucuaauuaucccccuguauuucagaaucuguaccccauaaauauuauaauuaugugauuacaaaauaagaaagguaggcauaguaucacauuccucuaaucaucccuuagggaggaaaagcaggcagauugcugggagcuugaggccagugugggcuacauaagggggcuggucucaaaauauguaucuuuagcauuugguaagcagaggcaggcauauauaucucugugaguuuaagacaaggcuggucuacuuaauggauuugagguggaugugagggcuacauacugaaauccugucucaccaaaagcuacuaccaccuccaaaacaaauccauaaucuuccuauaagaaaauuauuagguacuguagaagucacuauauucaauuuaguuuaaaaaaaaaaccagucuuaauaugcagccuaacagccauauuaccagccccucauugagggauucuacacagggcucuaccacugagccacgccccacccccucacuggaggauuccagacaaguguucuaucacugagcauugggcuauauccccagaccucuuuugagacagucucacuaaguuacacaggcuggccugaacucaaucuagcccaggccagucucaaacuuucaauuuuccugcuuuagccugccaggaucugccacccccguccaguuuaagauggcaguuuguuuuauuuuuaaaccuguguuuauauguauguauggguuuuugccugcauguauagcuguguaccguguauaugcaguacccauggaggccagaagaugacaucagauaccacggcacaggcguuaguuauugaaggcugugagucaccaugugggugcuaggaauugaacacagguccucugagaaaacagcaaaugcuuuuaaccacugagccaucuaucucucuagcuccugacaaugguuuuuaaaaacccagugacauauaggcauauguucucucaaccacagaguguuaaugucgucacagaucagggagccugagggaaagucccuugaaaguuuauaaagaaugggggugcaaaagagcaagcagcaucuugguaccacugugaaaaucauuuugaccucauggauguccggcucagcucuccagaaccucuugggaccaggcucaugcugcgagaauuguggcuuuguaucacuucaacaaaucaccauggccauccaacuacuguuuccuucucuucuuaaguaaaugucuuucccagcccuucccagcaucccgugggacacuggcagucugggcugugugcuagaucuagacuuagauuuguccuuuugcucucuggauuucaguuuccucggcuggaaaacugaggggcuuuuaugggugguggccuuggaggaugaccucagcuggggccuucugugacucuaucgucuuauggaucuacaguucuacgacccuaugacuuucaaaacugagagccuagagcccugaguauauuguuuuccagaccaagauugaaucuagauuucaauuguuucuaauguucuauaauuucaagaggccacuucugaguguggccacuaggaauaucgacuucagguuguauaugguggcacacucaaguaaucccaggacgugggaauaugaagcaagaggagagagaguucaagggcagucugagcugccuagugaggcaaugccuuaaggaaccaaggguugacuguaugacucagugguagccugcuugucuugcauaugcaaggcccuguguuguagccccaagaagggagagggagggagggaaagauggagugagggagagacaguuucagacagacaggaggggagagagagguucagagcaaguugcuggagguaggaucacaacuucaagagaaccucgguuacaaagaaaguuuaacgguagccugaaacucuaucgcauaaagaaaauaaaaccagauaaacaugaacucauaggaaaacuggcugggcuuaaaucucccauauccauaaucuugcaagcuguguggcauuaagcagguuacuuaguugcucucugcuacagcucccuuuucuuugaaggcagggugauaacacagcucaugccuuuggguugugaggaucgaaugaguagauguguauagaaugcuuagaacagugcucgucguguguguguguguguguguguguguguguguguguguguguguagggacugucacaccauugucauugucggugucaucauaauugccuaacaauaucauccaucaucaucuucuucaucgguaucaucauuaaacauuaucccaagauguucuggcucuuagauuuguuguucugaagauuuagugugucugggauucaaacuguccuggccagcacccaggaaguggagacagaaagguugcaaguuuguagcuagcuucgucuauaguuccugcuaguggaagauggaggcaagagacggcaguccagccugggcuugaucucaaaacaaacaaacaaaaccccaaauccuuauugguugugguuaauuucaaccugacaauaucuagaauugcauaggcaacaggccucugcgcacgucuuggagggaguuucugaauuagacacuaaggugggaaggcccaccuuaacuguggucugcagcauuucguggccucggguucuggacugaacagaaaggagaaagcaagcugagccaggcauuugucucgcugggcuuccugacugcacacaggaauugaccagccaccuaacacagccuuucuucgucaggcuggacuaguccugcccucaaacacugagccaaaauuaacccuuucuucuugaagcuguuuuuuguccucagugcugagaaugcacaacacccuaucgucuacuguucuaaggcuguguguggugcaagccucacagugccuagagccugaggcucucagaaacuguuggcuuaugcaucugcagaagcucagacucggcuacuggggcccacuucucuguuuggaguucacuuacagguggcuucagugguccgccggcuguaggacuuucggacacgguaccugacuaccaguucaccucuuuccacgguuggcucaaacaccucccuagggguugaagggagaaggugagggaugaacagaaccacguggaacccuguccuucuagugggcacugaagcaagcaccagugcauuccccagcugugcagcuugcucuccucuucagugcaugcugagcacaucuggugcugagcacaucuggaauuagcacucccugccuuccaucaucucuucaggucuccucauccucagacugcccacauacacacacacacacacacacacacacacacacacacacacacacacacgcacaaccuccucauuggucuuccaugacuucagcuuccccgaugaguucucacucacccauaucgagucuccuucuuccuccgauggacaaggaacagggccaagaugaggacgcaggcggcagccacaagugcucccagcaguacauaccaccaaggccacgagaaggcgcgagguggggguucacucacugucagaggguaugggggacagaucacacagcuaagcccccuggauccaguucccuggggcccaagugggagugacaugggagggagacaggagugugaccuggguggaaagggaaggugagguguguguauauagggggcaugaacauacagggaggggauagacgagugugggagagagcuaguaauggugcaggggagacaguggcaggauaacugugcagagaagugaccuagguguggaaugaccagugagugagggagagaauucacauagugcagaaggugcauggagcacaugcauggagcacaaggcugaggaacaauaaacuaaggaauaucuuuuaggagugcucaaggaggcgaggacaaacacacgugcauaagggaagugugugugcacgcgggcacuagcaagcaugagcacaaagaaugggguggccauuggaggaacuugggcacaacacaaaggagaaauguccaguuuguuuuguuuuguuuuguuuuguuuuguuuuagggagggucaaauaaaccccaggcuagucucggacuuaguaugcagccaaagaugucuugaacuucugauccuacugcuuccaccuccugagugcucggauuacagugaugcaucauugugacuggcuuauggagugcuggaccagggccuccugcaugccaggcaagcacucucuaccagcugagcuacaucuccagccucccuccccgcuccucuuucuuuuuagagucaagguuuuuugcagcucaggguggcuugaacgaauucuucugccuccauagccuucccaugugcugggguugcaagugugcaccaaccaugcaggcugucagcagugaucuuuagggaugugauugagcaugcaacaagugugcaaugaacaugcaacauacgugaacuaagcaugagcuggcaagugaggcgcacaggaagggcacgggggaguauaggaaaggacagguguagagaaaggagggaccgacuaugguuggucaugugagugugcuaagaguacaaggagguaggugugugcgugugucuaucuguguguguuugugugugucuguauguguuugugugugucucuguaugugucugucuaggcaugugucugugugucucuguguaugugucuaggcauguguacgugucugugugugucugugugugugucuaucuaggcaugugucuguguguguaucuguguaugugucuguauaggcaugugucugugucucucuguguauguguaucuuugugugucugucugucagugucugugugugucuguuuaggcaugugucuguguguguaucugugugugugugucugugugugugucugucuaggcaugugucugugugucuguguauucgugagaguggagcaugugcugggcaugugugaggaaggaagggcugucuuggggcaugagaggagggcugaggacauagaaggaggaggcauguaaagagcacugaaagcagugagcuggguucuaagugguggcucugcagcguuaggagggugccauggaaguggaagaagguuugagaauugcugaagaaauauuugaaaaagagaaucucucuccuuccuucucuucccuuuucuuccuuucuugcauccuucccuccucuucccucucccuuccucccauugaucugucuauucaucucuuauacauuccaucuauccauuggccuaucucuauaugaacucaucuauauguauaaccauucacucuccauaugccugcccaugcauccauccauuuauacaucuaccuauccuucaaaaaauuuuuuuugagacagggucuuacuauguggcuguccuggaacucacuacauagcccaagcuggccucaaacuuagagagauccaccugacccuaucuccuaagugcugggauccgaugcacauaccacuaugccuggcuaucuauccuucaguauucuuuucccacacaugcggcuauccauccaggugucugucaacccagucuccauauacuuauccauucaugcauccauccuuuaaucuuuccauccauucguucacccacccacacaguguauguuaauucacuccuuacacacccaugugucuguacaucuacccacucucccauaccacacucacugggccauucuaggcaccucccucaaggaccucacaaacugaagaagugaagggucagagagauguguuugggaugcaugacagcggcguguaaaagguacauguguggugaugaggcccucgcuguguguugagggaaggcagagaaagggggcgcaaaaagcccuuacccagaugguggaguggcuguccuugcccugugaggagaaaggacagaggagagacaugcucagagagggcgagacugacaugacgccaagugagcgggcugagggaggcucugugucaggcucaggguagcaacagagucuaagcugagggagcacucagaggcauggggaacaagucaagggugccaggaagagaccauccuaagggaagcuugaagggggcuggguauggcuuuagaguuaccugggcgccagggcucuaggggcacaggaaggcuccagggcccauccccagccgagguauaggcugucacagacacagucagguuagccacaggccuguccccccgcaguuccaaggucaccucucgaguuagcccuauauccauaaguaccuaggaaguccagaggcgacaucaggagggacaccuacaucuagaacuccuaagacucaacucuuguucauccuuuccccuugucucuacauuugucuccacaucucuagcuccaugcacucuggaacgucagcugcacagggaagaaacuccgccucaucucuggccauauccuuagcuucucagaacagugcuuggcaccaggcacagcucagcauuuguugaagaacugaauucucaucuuuuuguccucaucuaaccccuucuaacuucccaccccucucuccaccuugggguacagcuagcccagauaaaacaucuguauaaauuaggaaguuccucaccucuaagaugcuguaaaaguuacaacacccaagcccacugaggugcuguuacaacgcucacagacagacauuccucagccccuucuucuuggauccauuuaggauuuccggaaugcgccacaguggacaugguacaacaguauaguagugcccgguuuucauaauugccugcaucuauuuugucaucucuuccccaucucccgcuucccacaaccauuccacccuaacccagccagcagcacccaccucggggguguccuggccucgauaugccagccgguacccuaacagggugccuugcaggggcacccuuggcuccugccaacgcacgaggaccuggcucccauuccgcauggcgcuaacguucucagggggacccaagggcacuggaggacauggaagagggaagcugguacccccaccuuuuccugauccccuccccuguucccaggaaguggagcagguugcaaagaacacacgcgugggcaacucgugcaggccuuccaugagcggaagcacagggagagauuuggagagaagccaaugggcagagcucggggguuaggggcuggacaaagagacuaaggccauugugggauaaaggggugagaggagaauucagggugggaccaaugaaagcaaagcccaaugguaucuuccuccuaugacuuucuuaccucccucuguggucuccacaggaagccaguggguccaaggugaggggcccuggcugcugcugcaggauauccggaugugauacggggugugaggaaggagcuuuuccagccgaagcuggugggggggcacugauacuugcaaggugagggggucuucaggaggaucugacuuucccagccagauacccaccccaucgucugacagcacggccugaggaaagauaggaggaucagacgacaguuaacaguuacacuagugugugugugugugugugugugugcgugugugugagagagagagagagagagagagagagagagagagggagggagggagggagagagagagagagagagagagagagagagagagagagagagagagagagagagagaguuuguacaacucuauguguuguagcgccacaacaggacaaugggcauucagauuugcaaagcaaagaaauuguauggccacacccugucuucacccuugcaaaagacaccucuggcaagacuucccccaccucugccggcuuucugagccucaguuuccucauuuagaggaccagagaugccuugaaagguuauuuaaagauuaaauguacagggcuggagagacugcucagugguuaagagcacugacugcucuuccagagguccugaguucauuucccagaaaccacaugguggcucacaaccaucuguaaugggauccaaugcccucuucuggugugugugaagacagcaaccauguacuccaugaaauaaauaaacaaaauuuaaaaaacagacaaaaaaaaaaagauuaaauguacaaacugcaggagugguucagugguacagaguauacucuggauccgugauaucacacaaaacacauaagcaaaaccucaaagcaacaacucaaggacaaaaccaaccaaccaaccaaccaaccaaccaaccaaccaaccagccagccagccagccagccagccagccagccagccaaccaaccaaccaaccaaccaaccaaccagccagccagccaaccaaccaaccagccagccagccagccagccaaccaaccaaccaaccagccagccagccaaccaaccaaccaaccaaauaaaaacauuaaaugcaguugugcagcugauguggugacauacaacuauaauccagcucucagugaagcaggaggaucaccaguucaaggacagacugggcaacauaguaagauccugucuuggaaaaaaaauuaaaaagagaaaaagccaguaucuugcccaccauugagugacaagggaagacuccuuguuaugugacaaaguuuaaugauauguagguuaguuuguuuacaauauuaucaacuugucccccucccugacuucuuucuuucugagacagugcuauuauguaucccuggcugacuuggacuugcuacauugaccaaucuggccuucaacucuaaagacacaccugccccugccuccccagugcugagauuaaaggcaaguucuauuaugucugguuauugcuauuguuauuauuguuguuauugugauuuuugugugugugaguguguguaugcucuaggacaacuuauaugagucaguuuucuucuucuauuaauuguguccugggaauugaauucagauuguccaguuuggcagcaagcaccuuuaccuggugagccauccagcuggcccccaccuuguguuuugagacagcgucacucaguaggaccugggacucacugauuugcuagacuggccagccagugaauuccagggauccaucaucucccucugccccagcacugggguuccauguguguucuacuaugcucagcucuuuuuuuguggcuucugggguucaaacuuggguccucaagcuugcaugguaaacacuauacugacugagacauauaccuaagcccccuuucuggcacgacuggggaugaacccaaaggucucaucaauguugagcaaacagucugccauuaaacuauaccucaguccuaaaagucaauacauuuugagagccuacucuaugcuaagucccuugcuaagccugcacccagacaaacacauaaaucccuccugcccacuuagggguucaauuauuuuucucuuuccaguuuuacagauggggaggccaaggcccagacguucaguaucuuuccgaaaauaacaugguccccagagagggugacccuggcccuauaagacccgaggaggaggcagguuagugauggauagcaagagggggcaagucuacucucugacccacagugacauacaggaagaggaaccucugccaggacaaaggggagaugggugcagacagugggcucaaauucacucccacuucucuuuucccugggacagccaugacccucccucaggaacuguccagccggagccugugggcagcaggaagugagaccuggagaaggaagaacccacacuucugcuuuucuucgacacugcauggauguggguaggagggcagcuguggcuugacccgacauuugagauuguucaaguugguggaaugccaggauugaaccucaguuuuguucuucuggcuaaggggguugggcuggaggugcaggcuauuuuccuuucaggaucucucaguuucauaccuugaaagggaaaugccccgcccuggucaauucuaugaaugggcucuaccucaagucacacccccagccccucacugggagauucuaggcagggcucugccacugagccacacccccugccccucacugggggauucuaggcaggggcucuaccacugagccacgcccccugccccucacugggggauucuaggcaggggcucuaccucaagucacacccccagccccucacugggagauucuaggcagggcucuaccacugagccacacccccagccccucacugggggaauucuaggcaggggcucuaccacugagccacgcccccugccccucacugggggaauucuaggcaggggcucuaccacugagccacgcccccagccccucacugggggaauucuaggcaggggcucuaccacugagccacgcccccugccccucacugggggauucuaggcaggggcucuaccacugaaccacgcccccugccccucacugggggauucuaggcaggggcucuaccacugagccauacuuucagcuuucuaagucuuuuuuugagacagucuugcuauuuugcccaggguagcuuugaacucuccauccucuugcuuccaaaugcugacauuacaggccuguacuauuguaacucuccuguuauauguuccaucaaacagccuuaucugccugaccuaugcuacauaacauugaggugacgaugugacuaaaaauuaguguccuuagagagcccaaaugccauagugggaaauaccuacucuagaaagugacaauccagaguggucagggugaagacagugagcauaggguugugacagggacagcuauaaguccugacaacuuaaagaguuccgaauccagcuacacucaauauuacuaauacuaaaaacaauaaaaccagcuaacaguccauaauacauccccagacaauguuuuaaguuggcugcuugccuucauuuacugaauccuuauuucuaucuuguaaauauuagcauuaugaccaucuuauagaugggagaacugaggcccagaauggucuuugggcuuuacucaaauucacacagccaacaggugaaauaggugagucuuggauuaacugguucggaagggcugguuuuccauugagaagaugauauaggcuugugguuguggauagaaggaagguugaggccgaagugaucaaagucagagggucucaccugcagguugcagugggugagcggguagaugccacucaggccagggguccaagcuaccucuagcuccguagguugucuggaaaccacguggagauggugaggccucugggggagcacugugggcacacaagggaaggcugacucuuaggaaacucuccccagagcccuccaucuucccucugcuuucuccucucaccucugguccagccucccacaccccugucaccaagaucugugaacccucuuguuguuaccugugaugguggcugugcgggagguggugacucccuuggcauugugggcuucacaugagaaagaagaugucuuguucaggccuggggaggaauaugagaaagccuagugucacgguggggaggacucccacaccuugucacacagucacagacacacacguauagaugcagacagaaacacguaugcuuacauacauauguacacagacauacgcacccagacucauuuagacucaugaaguguucacauguacagagccagaugguacacaccugucacaccagauaaugggcaggcugaggcaggaggaucucaaguucaaaccugccuggcagagugaguucaaaauucucaucucaaacuuaaaugguuaaaaagugaaugagaaaaagaaacaaagucgggcgugguggcacacgccuuuaaucccagcacucaggaggcagaggcagguggauuucugaguuugaggccagccuggucuacaaagugagcuccaggacagccaggguuauacagagaaacccugucucgaaaccccccccccccaaaaaaaagaaaagaaacaaaagggaagagaaaggaaagauaacugcuccuagguaugggggaggggaaguuuaucacagacacguggaagagcauagccagagauggggcaucuaggagaguccaggguggacauaaucagacugagcugggucaugugguuggagggggaggggcagggagaggagagaggggaaaugaggcacagcagccaggaggcccaaagguaaacaaaagaccagguaaacaaaaugguugugcucuaugaggaaaagcagcccagucccuuggguuggagaaguuuaagguaggguguggauuauaauggcuagggggacccuguauacggagugagggaugcugggagaaccuggaggugggcugguauguuaaguaggcuccucagucguuugucccaggcuugaaaucuaacaaaaaggauccuggaaggggcuggggagauggcucagcaguuaagaacacuuacugcucuuguagaggaccaggguuugguucacauaaccuacauggcagcucacagcugugaaucuagcuucaggggauccaaugcccucccugaucuucacuauuauagcaugcauauaucagguccacacacauauagucaggcauacacauauaaaacagacaagacuguggaagagucaucccuaucccugcagagaaaggggucaggggggcucuuauaucaacaugccaacauuaccaacauacacucacacaggccuacacagacuuacacggagacacaaacaaugaacgcacacuuaaggacagaguauauaauaauguacauagguuugcucauugauaaguuugucuccuacaacugcucucuuggucugcuucuggucucucucucucucucucucucucucucucucucucacacacacacacacacacacaaggucuucucacaggaugucuauaugucuaugugaccucagccuccuuucuucaugcacgucuucuuggauggcacaccuaagucacccugccccugacuaaucucuguagaacuggaaccuggcuugguuuccucuccucgcugccagcuugcucacacguugcccaagaaucauguuucuuagggcucucucucagaaucuccauuuuaggagcgcaggaaaugucuguuuuuguaacccugagguggcagcauggccgggcacacaguagguacucuacaaaugucuguugaaugagugggagaauuuuuuuuuuucccaagacaggguuucuccguguagcucuggcuguccuggaacucauucuguagaccaggcuggccucaaauucagaacucugcccgccucugccuccugagugcugggaucaaagguaugugccaccaccaucuggcugugagugaauuuuuaaaaagauugugugugugugugccacauuuauucaggugcccucagaggccagaagagggcaugggguucccaggagcuagacacauacaggaggaugugaguuggcccauggagguucugggaauugaacucagguccucuguaaguggagcaaguguucuuaucugcuaaacacucucuccuuccccagugaaaauuucugaucaagcccagggcugcacacaugccaguccgaugcucuacagaugaaccacacccccagcuccucccugguggauucuaggcagaugucucauugcuaagcugcauuccuagccuucuuuuuaacuuuuccuuggagauaggaucucacuagguugcccagaccggccuuaaacagacccuguagcucagaagaguuuugaacauguaauccucuugucucagccucuggaguagcuggaauggcaggccgacaaaaccaagccuuacaagccaaugaacacgugugugcaucuguguuuggguguguaaggaagaaaagggagccugauuauguaacaggccaaacaagccaguuaauguguuuuugaauaaaugucuuugugugucugggaaagguucgugggccaagguguuugucuugagucucuuguuuugucuuguuugugugugcaacugugucaucacugugcacacagacacacacacaaguguguacaaauacaaauacucaagacacaggccggcaaacacacagauaugcaauacccaugugugcagaguccucuaguaccggggcugcaauucugagccugguggauguggaugugcuugcguucucccaucuguguuucauggcuuguguaagucugagaacagcauguacuugugucacuguggcaucugcguuugugcgagcgcggcguucccuccaccugguauguuggagggcagccucucucucggcagacacaaaguuuccuuuucucagucagcaaagggaguggaacaggggaaaauccgucuugaaggccggaaggggguggguagggaagcgcccuagccuuggcugccccggcuggcugcgguucccagccaaggucaggugcccgcggcgcagcccccucggcccaggaagggaugcgcagcccugggagggcacccugaggggggcaagcgcuggaucacguccagccaccuggcacgugggggccaccacgcggggagcuggcgccaagggccagccguagcagccccggggcaaggagggggguugguucuggagcucgguucuguuccgaccgcagcauuccugcccccgccugagucaccggggcgccccccacccuccacuuccggccuguccuggugggcauagucugggauuucccauucucaugccccaggggcugcaucucaaaugaggacacugggaugagcugaggggucuaggaccccucucuccuccugcacucacccuacaggaaagccuguggacuccagauguguuuuccagauguacugccccgcccccaccccauccgcucacucccacccauggcuuuucugagggaaagagagagauggagggagaagaggacacgcccugacucagauagagagggacagagaggcacucacacgcacaaacugacaaaauucuuuuacaaagcacccuccccucccccgacagugaaucacucuuaaauacacagggaccguuauuagcacaaauguaaacacacagaaaugcagcacuggcuaagcuauacacuauucacagggcggaugcuguaccaaacacagugacauaaaugcacugggacuuacugguaaacacauggagacuaacaaugaggcauagccccauaaacagacagacagacagacagacagacagacacacgcacucacgcgcacacacacacacacacacacacacacacgagucagugugggaaggaacauauaaacacacagucuaacccucacacaugcacugcaaacaccuggccaaauaguauacauaguauaaauacugagaaacuacagaacuucguacagaacagcguacuucugucuccagacaacacauguugaaagggacagacaaaauggauacaaacuaggaagcaauaaaaguuaauguugacuccccccccacaccacacaaacacacgcagagagagaaagagagagggagagagagagagagagagagagagagagagagggagagagagagagagagagagagagagagagagagagaaugcuagcuuuaucugugccaaaacagaaacacagacggaugggaaaacaggcggauggggaaaacaguuauugcgcagccacaaaggcccucugcagagaccacaagauggggacacugccacauaugccacauaugcauggguuggcacagauucauggcuaacaggugagcgcuuaggguucagucaccaagaaucagaggagucaguaacagacccagagagagcagguguguacuaauauucugcugcgaaucucuuugguacaugauaagacacagaacuucauggugacgaucauacuuuucuuuccuuuuuugggggaggaggauugagacagggcuuuucuaugcaauagcccuggcuauccuggaacucacucuguagaugaggcuggccuugaacuaacagagcuuugccugccucugccuucugaguaagugcugggauuaaaggcauacagcacacugccuggcucaugcuuuuccuuugauggucaauaagaaacauaccaaccuagugacacaggcaucuucccucucucuuuggagacagggucuugugaagcccaggcuggucuccuugacuguugggauuacaggcacaagcugccacaucuauaugauaucuugauucugcaagggacugggaccucgcaacaguacacacaaccccccccccccccggccuugcacccugugaacugauguuguuaccuuaauauacagagguuuucaagcuagccacauggugucagcagcucuggucucaugaacggccaugaacacagagcacagaaggaaaacagauacaagacaaaguugaccuuuagugacagcuacagagacacacucugagagccacagagacuggcccccacuaagacauucuuuccuacuuuaagcaguugaugcugguggaucugccgacccgagaggacagggcuacacauucggaaauccucaccucuuugcagguguuuuugucaguaacacacugagagacacagacgacccucucacaccugcgggccccaucucuucccuccucccuucuugccagccaggcugacucaagccccauucuuaucccuaucagaccacucgagccacaggccugacucacccucugggggccagcaugcucaucacacuuccuugcacacucagggcucccagaaugcugggaaugugagcugucccccuccauacugaaagacccauccucaccucccccgagaggcagcagguaggauuuuaggaagccguuacucauccagauauugcuauguguuccuccaucucuucuucuuuaacaagguccccuagcccugucucugacuaccaugggacccuaagcaaagugaccaaucuguauaguacauaaagggagggucacgcugaaauaggggugccguuauucaggccacauuaucacgugucucuccaugcugagucacuucaguaaccuguucucuuuuaauuuuucuuccucaacauguccaacguuaaccucuaacuuacuauauagucagggcuagcuuugagcuugauaauugaggaugaucuugaccucugguaguccuaccuccaccagugccgugauugcaggcauguaccacggagccagguuuccauggugcuuugaguggacagggcugugagcgugcuaaggcaagaguuuuaccaacugauuaacagccccagcccuuugguuuucuuggguuuuuuuuuuuuuuuuuuuuuuuugguuuuuugguuuuuugagacaggguuucucuguauagcccuagcuguccuggaacucacuuuguagaccaggcuggccucgaacucagaaauccaccugccucugccucccaagugcugggauuaaaggugugcaccaccacacccggcuccuuugguuuucuuuauugacagggucucacacuguaacccugggauggccuagaacucacuaugucagccagacacaucucaaacuggugacaauccuucugucucagcuuccaaauucuaggauuauagguaugagccuccacccuugucuucccuaauugacuuucucuuuuacucauuuucccucccucauucuacucugggcucugcuuuuccaggaaagcucagccgagcauggacugaggucuagggaacacuucagaucagggggugggcaggucaaaggaggaaguggacagaggaggguauugguucauucugaugccuugcuugggucagggcugacaaaggagcaccaggccuacacauuugggccacugaacagcauuagagauuugggacaaagaaugcuauugaacagagaggggcuguggugagcacagagagagagagagagagagagagagagagagagagagagagagagagagaaagaaagagagagagagagagagggaggagagagagagaggcuggggugaacagagagaggcuggggugaacagagagaagcuggggugaggagagagagggggggcuggggugaacagagagaggcuggggugagcagagagagagagagagagaggcuggggugaacagagagaggcuggggugaacagagagaggcuggggugaacagagagaggcuggggugaacagagaggcugggguaaacagagagaggcuggggugaacagagagaggcugggguaagcagagagaggcuggggugaacagagagaggcugggguaagcagagagagagagagagagagagagagagagagaagaagaagaaggaggaggaggagaggaggaggaagaggaagaagaagaggaggaggaggcggcggcuggggugaacagaggcacacacacagaaguagugaaacagugauggagagacagagggauggagaacagacagacagaugaaaaaucacaggaagggaaauaagacagaagacagagacaaguagacagacacaucgaaugaagggcccuggcugcucugcuuuggcccacucucagacucaccuggaguuugcagacugugcugggagcuguguccugugacuggggccagggggacagcaucuugaagccagaguagggucacggguuccgggggucccugggccuggcagcuuagguugaaagggguguuggcaggcacagcuuuguccucaggcuccuccaggaaguacgggagaccugggcagucaaggacagaaacuugguucccucugacccucucagggcccccagauuaucauuaggauguuggaggugcuaaacacuacauccacccugcaggguuuuugacuugucccuuauaucuggucaccuaggaaacgugcgucaccuucagauaucugauccuuuaugcuuuuaugccuaggaccaugcuuccaacaucugguuuagccuaugccugaccaccuugaacauuuuccagggcauguaaaagucucgccuugucuguuuuucuuuuucucuuccucuuccucccccucuuccccucccccccccccaucucucugagauacaaucucucuacagagccuugacuguccugaaacucacuauguagaccaggcuggccuugaacucacagagauccuccugucucugucuccuuggugcugggauuaaagguguguguuagcaugccggggucuucuccuuuugagggucuuucuauguaucccagacuagccucaaacuacagaucaucugccucagucucuugaaaguggcaauuauaugugugcaucacuaugccuggcuuuccucguaucccuuuccuaaugaaggagugagguacuuggaaauaugggagaauuaacuugugugcagcugauucccagacuagaagguccuacuccaagcauaucugauuccccaggacauccaaaagcuccccaaaucucucuccucugggacauagaccugucccccauaauguauggccucccaugccuccccaacuaccaagauucccuaagucucuggacuuuaugucccaaugggaaaagcucugaguucuucaccugucauccccgcauaagcucugacccgagaacucaccuuccagcccuacaaagcccggcugagacacaaagguccguccuucuagaugcaccauacacugguacuccccugcaucugaaaguugcagggcugagauucuagaagggaagagggggauuuagaggcugggggucagagcuggacacugggauguggucagcagaacugaaagagggagggggucuggacaggaaacuuauaggaggcugaaguagguccuauuuuuaacucauuuuuacagaagaggaaaacgaaacccagaggucauaucacaagcucagagccacgugcccaguaaguggucagguggagauucccaacccagguggaggggcugcccaguggcuuggugcggaagggcuguguguauggagcucccuggucagugacaggugccacaccugagcugacugacaacuuuccauucaucuugccagucuucgcccagaggcaccugggucuggguguuaucagccaguucuaggaucuguccaucucgaagccacaccaccucaggggguucccccugaaccuggagcucacaccgaaguguccccgugaguccucuggcaccugugauauucccuggguuccccacaaacgggcugccagccucggucugugugucugucagggagaugguaaggagcaugguuaggaaacccgcagcucgcugcuccucugguccaccuucccuaucugcccaugguugccaggaccccacauaguuguagagugaccucagaggggggugggguggaggcaugggagaggauaggagucuucccaggggauugagguccggcuuccaucucauguccagucuguuaggaagaaggccugggaucuggcagccucccacgcccuggacugccuggcagggccgguccuugccauucuggucucuagagacuucacagucuggacugggagauagaggaaaagaaaacggagcagagaaggaaaggaaaggggaggggaggggaggggaggggaggggagagagagagagagagagagagagagagagagagagagcacuccagcagggcaagaacaaguggagggggacagcagugacaaagggggcccaggacucccaaacccuccuucucuagucuuccucuguguuuguuggggaaagagcccuuucuguaaucuggacccucuagcucugucccucuccucaggacacagauuccucaaccccccagcccucccucaacuccuccugucugucuuucugcccaguccaucuuuugguccucccgguuacuguuucuuguccuucuauuccucucugaguugcuuucccuaacuccaggcucuuugagucugugucuuucugccgccccccccgcccccccccccgcgcgcgcccaggccagcacucugucgucccaaggaaacucccuaagccagcccaguacccauaacaccugccagccagcccccaccuccucacugccccugcccuggaucgcaucagccggcgucucugccucagugagaccccaucacucacccuuaugggcugcacacccccagcagcacagcgccaaccaccaggccagcgggacccugcccauccuccagacaccaacagcucagauugaugccaaacuuucuuccgaaguugaugggcaccucgc

SEQ ID NO: 12126 - RNA, 3639 nt, Mus musculus
cgguggcgacaugagcagcggggcggcguccgggacugggcgggggcggccccggggcggggggccgggacccagggaccccccgcccggcgagacucacaagcugguggucguaggcggcggcggcgugggcaagagcgcgcugaccauccaguucauccagguagugggcccucaccggggaggguuuccccgagaucgagacuuugagcccuuuggguucccugaaacuuucgcuucucccagaaccaucauuaagacccuccuaagaggaucucuaacccucugauugcgacuccaaaugcccagggccuccacccccuucaugaggggaagcuuucuccuaauauguccugggacaaaucacccuccuagagguaccugagagcccucauccuagucugucuagccccgcucaccaacugggaguacccuaaauuccaaacaguugcuccauucagaccccaagcacuccccgaggcucuaaucuccugaucauugcccagacuuugauucuaagacucagcugggaccacucuguccuaaaacaggcacccuguaaccccugcuugaagaggauuucccuucagaccugagauuucagaaagauccugcuacaugaccauccugggaaaacaccaauaucuggcauaccccauucugcuaaaugcagccccccauccuacccccaaggaaaaccaaccauuucuccauccuaaguuccccacucaaacuccuuacccucaacccugaaaacucuaaguagcucccaugucaucuccagauuuaaaaagaaaagcauagaacucagguuuuucacagccuccagagaccuguuacuuggaagguucuaggucccauaaauagaccucuccuacaucaggaaccaacccuccaggcuguucucacccuugggcaucuauuuacuuugggguccuaaucauccccccacacacaccaaaccucauccucuccauuccuugcaccccuuuuagccucagcccuuagcaagcacucuagagaggaagccaccuucagccucagcagccaaguucagaaaauccagcccagccccggaaaccuccacccaguucccacggggagccuccccacaucagggcaacacuaggaaagugagggcccacuugcuguuguagaaguuccugggugauggacauucacagacuaggagccuccggcaaugccguugagaaaccuacagugggaagaaagaguccaaauuugagccccuagcaccaagggccaaaccuggagauggccagaggccugguuggaaguagcaggacacagucaggaagggagaggcggggauaaggguggggcugccucucugaagcaggauuggaaccuagaccuucccaggggaggagacacuggaggcugcuuauggaggagggagcaagaggagggaaggaauggggggagggggggagaggaagggaagagagagacagcaagaucggcagcuacuuugcucaaccagaauucucagaagcuggucgcugaccgguaccaggucaaguguuaaguguugagcagggaauccuugccaaucaaaacuguuagaugguauagugucuucauccucgauucuccaagugacgaaacagccucggagacagaaagugauuuguucaaagugaugcagcugguguaaugaugacaaaggcugaagaagacagaggggcuaagagaggaaaacgggggcgggcaucggugacagggacccacaaccugacaccuggaaagguggaaacagcaccgccaggagcagguuagagauccagagagaaaggggguggacagaaacccagagaggggagagggaaagagaugggaccggcaaagacagagagaucagagauuggggggggggggguguugcugagacaucaagagggagagagaccaagagaaaaagacagagacauugagacucaggaggggccagggagagaaagacagagacacagagagaggggggacagagacuuggagaagauaugggacaggacucacacacacacacacacacagauugcuucggugacagugaccuucucuaccccccaguccuacuuugugucugacuaugaucccaccauugaagauuccuacacaaagaucugcacuguggacggcaucccugcacggcuggacagugaggaugggauggcugggcuuggaagggaggcagggggcaagacucagaggauuugugaacaugcccaggacaaccuggggggacccacacguuucucucucugucuccacaguccuggacacugcggggcaagaggaauuuggugccaugcgggagcaguacaugcgugcuggcaacggcuuccugcugguguuugccauuaacgacaggcagaggugagggggaugcuggugggccuggcugagcacggggcagguuccugcuaagguggugccucaugcuacugacuucucuugcaguuucaaugaggugggcaagcucuucacacagauccucagagucaaggaccgggaugauuuccccauuguguugguugggaacaaggcagaucuggagaaccagcgccagguuugagaugcccccuccccuggucacccccauuuggaccuaggaagcucucucaggugaccaucuccuacucuggaucccuggucccucuauugucacaacuuucacuuaagagaugaccccccaagaggaaucgcccaucacugagccacaccccuggccaucacugagggauucuaaccaggaccccuagcacugagccacgguccuggcccuuauacuaauccguugauacugguuccccuguccugaacaagaacacccuuacuucuugccugccugccuuccaguuaccuaaaacaccuucauaaucuuccugacaucucacugauaucacuucaacccuccaguagccuccucuggggucuuucuagaacuuucuaucuugagccugcugcaguuauacagucgagcacaccuugcggcggcuuucagcaucuccucucuccgacgccucccuuuguccuccucccucugucuuucuccagguccuccggucugaagccuccucuuucagugcuucccaccacaugacuuacuuugaggccucagccaaacugcgucugaaugucgaugaggcauuugagcagcuggugcgcgcuguccgguaagcccgguauccccuuccugaccucccggucaucagcccugcaucacacacucacagacugcuucccacaggaaauaccaggaacaagaacucccuccuagcccaccuagugcucccaggaagaaggauggaggaugucccuguguccugcuguagccaaauagccucaagugaccagcacaagcucucgggaccagcugccucacacuuacuguguggaccaaggcucgcucuagcugagccucuguuucauccucuggguuccccaggacacacuacacccucuuacuuuuacuuccuggccuccuggggcuaccacugugugccuucugucaauaccuccuccuuuccccacaagacccuguagguggggggagcaucuugucacugcuguauauaagccccaucuuucagaaaaauaaauaucacugccaac

SEQ ID NO: 12127 - RNA, 77979 nt, Mus musculus
ccugucgggauacucgguccgcccaccuaguccucucguccagugcugcguucgcgagauccguauuucucccaagaugguggcgcuccucuuugggugacuccaggagacgacagggccuuucgucuuugccagcaccucgucgccccuccugcgcucgcucucucgcucgcgcaccgggccacgcagcuguucaccgccucguuacgcuucucuuccgucgaccugucgcugacgguggcgccuccuucugcuucucuucggaguugcucgccgcccucgccccccacuguggacagaucgcgacagcagcgcuucagcgccgacuucaagguugcccaggcgccuggccucucggccucgguuuccugaggagaagcgcgggucccgcaugagacccggcgguggcgccagcgaaagggaacgaggcgguggcgggcggcggcgguggacgagggcgacaaggaccagugaggcggccgcagcugcgagggccgcagcccacgcgcgggggcgaggacaggucagugcugcugcggcugcggccugcccggcgcgcucccucuggucuguaccgccgguccccucgucacccuccggcccgcgcugacaggguaggcgccgggcccucacccgccuccgugagcgagugcuuggggcgcguggucuggaggggccggugccaggacuaggcccugguggcugcggcugcugcagccuuaacugucagugcuggcuggacgcaggagggaggguuuugucacccacggguacccgagugggcccgggguggggcggacgugcagggcgucgagaucgggggccucaucuaagcagagaucggagagccagccguggcuucaggcugcgaaaggcaggccuuuuccuccaaaggggcgcucugguggggaagacauauuuagaugugugcuuaguggguugggguauuggggguggauuggaaggaagacggaugaagcggcaccucaagcccaaggauugcgcucugguuuuauucgugugcugcuucugguaggauucaguaguugaacgugaguuacugauuccucagaaacugcuguguuaauuuucaaugcaaaccuguaagcaguuggccuccuccucuucuccccucccccuuuucaguugagaaaaugaaaaggacguuuuccccauuuugaugcggaggcuuuuuguuggaagaaucagaguugaaugugcuauaauugcguuagccuuaaaaauagaaaguauaauuuuaauaagacuuuaucagcuuuagaagaauccucuaaagacaauuuuacgucaauuuuuuuuaugucuuuugagcaugcuaaaauagaacaguauaaaaucucuuugggauugcguuaaauagcuaguguacuguuggaaauguuaacuaaauaguauaugggauguguuauccaccauuaucuuacuucgugaaggauauucguauaacccaugguuuugggagaagcagcagauuauguuaaaauguuuuggauagggaagugcguuugaaauaaagauggccugaacuuuaagaaauacagcuguuaaaaagcuaaauaucaaagcccuauuggacaagagacacgacgaauguuuuugacacaccucagauuaguuaauacucuuaagauaucuuuuugguaaauuauguaaauuuagaauugaggagagauaaaaggaaaauuuugucuuguuauguaugacagaaauugcuuuaguauuaaauucuccucuuaaauagacugcuuacugcacuuuuaaggaaguggauacugcaucuguauugcugauaagccuaaguaaggaugacuguaaauccauaaauacuuagcuuuacaaaaaagccauguaucagaaucuguaauaaaaaugagaacuucaacaauucgcagucuaucguuuaagaaagauacagcacauaauaaagaugagaugacuuguaguuuuguuuucaaaaucagaauguagguugugaaauaauuugugucaauauuuaccuugcaugguguguugugaagugguauacacauacuucuuuggauguugcucuucauauaacugaggagcuuaacuuugaguuuagaaaauuccuuuuguaugcagguuuuguagguggcuuuuuuaucccugaaauagccaccaucacccuuuuuuuuuuuuuuuuuugagaaagggucuuaugguauaucgcuggaugacgucuaacucuccucuuggcuuugucuccaggguucugcgauuaaaaauguauaccaccaggaccggcuauuuacccuuuuuaugguuuuaaauuagaaaaaugugauuucuaccugagacaaaacucauucuauuugauucguuuuuuuuuuuuuuuuuuuaacauugcauucauuagguaucuauaaugucucugacauguaaauuuuauucaguuguauuucuuaaacauuugugucuucccucaaauaauugcaguaauaauuguuucucucaauuuuuaugaacauuuucuuuuuaauuggccauagcuauuuuuuuuucuguucaagagcuuaagaugaucuuuucaaauguccuuuaaaaaaaccaacaccuuaaaugaaugguuacugguauauuaucauuuauucuaauuagguuuguuuguuauuauugauaauauuacuguuaauggauuuauauuauauuuauaugcagcuauuaaaaacaucaguguucugauuuuugcaacuggagaugaguuuuaagagguggucuuuuaaguacuuucaaauacggaaaaacaauauaaaaauauaaaaauaguccucuaagucuuuugauguucucuucagaaaggcuuaggauaauagaguuuugguuuugacaguuacuuuuucuuacugauaaaaauaaagacaauguuauguuaggcaugaugucucacaucuguaaaccaacaauugagaggcuaaggaaggauuguggcaagccuagacuaagaggcgagaccuugucucaaaaaaguuaucaaucagagaugucauagaauguguaauugaaaacuuuuuucuuuaauuaauuaauuaauuaauauuuuugggaggcaggguuucuuuguguagccauggcuguccuggagcuagcuguauugaccaggcuggccucagacuauguuuccagaauccuuaagucuguuuggccuauuuauaaaauaccaaagacuggucaacaccccccuuccccccaacuccaaaaaauguaucucacagucaaggacacugagaaaucuuaagaucagaacuaauuuucauuguaaauuugaguaguguuaggaggacuaaggacugaaccuagggccucucaaguucuaggaacugcucuaccacuuccuaguccucuguacacacuccagcucagaccuugaaaugggaguccugccgccuuccauaggagcugugauugcaggccaguaucacuaugucucuguaucucugucucuguuuauuaggguuuuuguuuguuuguuuuuguuuguucuuuuuuugauuuuauuauaugagaguccacauugguguggugucuguaggggugagaagagaguguuggaacugcugugacugggauauagacaguuguuaauugccaugugggcucuagaaauugaacccagguccucuggaagagcaacaagugcuuuuaauuuaacuuuugaaucaucucuccagccuucccuauauuucccuccccuuccuuucuuuuuucuuuugucuuuuuccccuccccgcuucccuuucuugugucagugucucucacuagccucugaagcuagguaaauagucgaagcuggccucuaacucaaagauccaccugcuucagcuaagacuaaauggucuuuuaaaauuaggacauugcucucauucaucaauguagguccuccuaaaaauuacacuuguaauuucaucaccuccgauuuuaggcuuuuagugaaguuuuuuuuugggggggugcaaagauucagaucacauagaagaauaugucugaaauaguuaucaguaucagguaguguuucugaggcuccuuugaauugugugagcugacauggguuauaaggguuaaaaaaaaagaaaauaucuaucauuuggaaacugauagguugguuauuuauugcacauaacaccauuuuauuuuuuaaugugauaauucuguuaaguuauggaauuuaauugucugugccccuccaguuuuagggcaguucuguagacuuaauaucccuuaaccccuuagcuacaauuguaaaggauacuguuuguauccuuuuuuguauccuugguauauguguucaugucuuacuugcagcccaucaauauccuuuuacaguacacaugcacaugugguauauauaaaaugaaauagauuuagucuaguaugcuacucagccuguuaggacucauuuauuuggacaaugauuaccauucugauucaauaauaagagucagagauguuuguuuggaagaauagcuacacuuauuuugcaauuagcaauucacuuuuauggaguuauauauuuuuauacuauuaguaaaauauaauccuuauaagauagcacaggauuuaauucuuuuaaauaaaagaugugaaauaaauuguauuaaguagaaauauuauuauuuuucucaauuucuuuuuccaaccaugaaaggcuugaaauacaugacacuuauuccuucuuaauaaagugacuuauuaauguacacaucagauuuccuuuguuuucauuuaauuucaaaauauuaccuauacuuucuugauuucaguugucuauaacaacuaaacuaaugaauaguaauuuggaaagauuauaaguauugggccuaucuauacaugaaaaaaauuuuuuauacugauuuuugaaagagguuucaauauacauuacuuauuacuuuuagguuuuaccugaagccacagaauaaguaaauggcucagaauuucagugguuuaggaaacaaaacaacuuaggauuauugaaauggaauaaagaaugcaauauucauguugucagaaguugcugcuuuccugacaucugucuugagccagagugagcuaaauaggagcaggccauuuaucuuucuaaggccuuguuaaucauauuaaagugguacugccuucuuguuacagaggauuaugcugcucauaugugauacuucuugaacauugauagauacuguauaaagaaaguaacuugcccaggaaauuuguaggagaaaggaugauggaauacgguuauauuguuuucuguuaacauggcuaagccuccuggucuuucugguauguaccucuuuugagagcugggauugcagggguauaucuccuuuacagccgcaauuacaauauaugaauuaguuucagauuugauaacuauuucaauaagcuuagguuguuuuguuuccuaaaccacugaaguucugaagcacuuauuacuucuguggcuucagguaaaaccuagaaauaaguaauguacauuuaacaugaaauuguuagugauaaguuauuugcaaagcugaauuccuugucauuugcucuucuugaccugauuuuuaauuaaaugaauugcaagugaaucaguuauaagaaugaugggaaaggguagccuuuaggggccauaguaccauaguuaagcuuauucuugcaguucaguuguagcaaaucugaggagaagccucacgaagaaauugcauuaggcuuaugaaggagaauccuauguaaaucuugcugaagcuggcauccuuauuugagugaaaccagaguaguaguaguaguaguauauagguacugaacuuuuuauaugagcaggauaaaauuuuccuuacacauaaccuuguguguaaucuguuguuacucuuagcagcagcucaguacauuucagaauuuggucuuucuuaccugucaacaucauuuaagcaguauagcacaacucucauuaauuugacagaaaucagauauuaaaaaaaauccuucaauuuuaguuuuacauagcuggggauagaauacagggccuugcuaccuagcagugagcuacaucacuagguugaaaaaaauacuuugaaaaaaauauguuauggagccuuagaaaucuaguuugaauggugaugggguaugugugugggugugugcguggauggauggugguagcuguggcggcagugguggugguggcggcggagguggcggcggaguaguaguaguugauaaaaaucaugguauguaaccuaggauagacuguaucuggacauguagugcagacugcccuugaauucuuggucuucggcccaagugcugagacacuuuuuaguucuuguuuguuuuauauguuuuuuuaaaagacagaauaucuuguaguccacacuggucucaauuucuuaguaguugaagauaaccucaccuacuuauccuucugauuacacugcuccagugcuggggacuaugggugugaaccaauuuuuuuugugugugugugguguccaaugcauauaucuucaauucagaauguucuucuggacauuuaaagcaagcaguuuggcacacaaauuacauagcuaugacaugaaugaagauacugucaguguuguacuuuucugaacggugguuuuuuguuuuuuuuguuuuuguuuuuguuguuguuguuguuuuugagacaggguuucucuguauagcccuggcuguccuggaacucacucuguagaccagggagaccucaaacucagaaauccgccugccucugcuucccaagugcagggauuaaaggcgugggccaccacugcccgacagaacaguguuuuaaugugauaaaauuuuucuuuuuuuaaaacaaaaaccuauguuuuuuuuauuuguuuguuuuuuugcuuuuuugaauaaaagagauggcuauucacuuaaaacuucuaauggacuuucugauaugaaaaaguagucuuagagauaccauuguggaaccauggccauaauuaauuuaguuuuauaaucugugauauaaaauaaaugcugauaccucuaguuaaauauagaagauaugaacaauauagaagaaauuaaaagaaaccaaccauguaauguaccauuuaguuugaacaaacuuuauauuuuguuauuuccuugaauucuugucuuuucugaaacucauuccuuguuuucauuaguugauaccacucuucucauuauagguuucagcacuuuaccuaguaucagaugugaaucauacugcuauuuuuuuggaaaggaaaagaugaaaugcauagucccucuuucuuuuuuuuucuuuucuuuuucuuuuucuuuuucuuuuucuuuuuuaagaaaaauaaugccuagugcauccuaaggggaaguagaguagccucaauuuauuaguauuucucccuuaagauuucuauuuacuaugccccuuuguguagauauauuugcuaagcguacaauaugcuaaaaauaaagauaauauuugccuuugcuaaauguguuuuuguuugguaacuuaaaauguuguuuuuugaguaccuguuguauaguauguauaauaauagauaaaucuuauuucagauaaagacucauuagagaauauguuuuuguccucacuuuugaagugaccugacucuguaucauguguuacugauagaaaauacauuaagaaaauccaaauccuuaguuucaaagaaaugaaauuucuccgcuuggaaauucugucccauucuccauccucucuguuacuguuucucacugauucuauaacauuguacaggauucuagacuggagaugggaauaagaaguuauguacaaguuuaggaacuuaaaggaggaauauacuuuccucuacagauugggcuauauaauuuuaaaguaagagcucuuaaagcauaguaggagaacugagcuaauuuuagucuuuuaucuguacuuaacaucauguauaauuacuggcugguacauuauguuucaugucacuuuaaaaaugaaagauuguuuuggucugauuuaacuuuguauggaucaucuuucuacugauucugaaauuuucucuuacuccauuuuuuuuuuuuuuuugaguuaaaugaaacacagggaagaggugaacguaaaaacagauauaugcacauaacuuaaccaguugaaauuagaugucuauuccuauacugaagagucugggagaacaguaaauguuuguguacacauuuuguauucuguauccuuugucuucucccuuuuuccaucuuuccucuucucuuuuuucucucuuucuaaccucaugucucccaguucuuuccucucucacuguucucucccuuuuguccuuuuccuuucccuucugcagaugcagguauuuguaaauguuggauugaaugaacuacuuucuagauuguucaggucuggguuaggauaucugcuguaggcucuugaaauauguauguaugguaauacauaauucucuaggcuugagaauuuaaagguaaacagaauuaagcaguacuauaguggccuggacaauuaacaaagaccuucugaaggucuuuuaaaaauugauacuaauucgucuuuuuaguggucaagagauaauagcuuaauuauuuagacaccuauucugcgcuuaaaauuaucauguuauaauaauaguuuuuuuugggggggguucuuggcauuaaacccagggaacauuucuucuaguccuuuaguccuuuauauuuugucuuaaucuuuugaauuauuauuacuauuauuaucauuauguguuguauaauguguauuuggacauaagagugccaugcugugaugcggguggaggucagaggauaguuagguagauuaaggucucucaauuuuuaacuuuaaucccagaguguuuuuuuuuuuuuuuuaaagugucaggcuuauauggcuuuauccuacucauggagauaaucucaagagccauacauuuuuaucuuauuagcauacuuuuaauaaauugggaagauugugucauggaagucuccauagucuuaggguuuuguuuuuagcuuagaaauuguauauucagauuguuucuuauuaaaacauguuauaaaauauuuaaagcacuuaauaguauaucaauaaucuacuuaccuaccauccuggaauauaaaugccaguuuugauuuuuguuuuggaaacuuaaucucuuccuccaaguccuaauacccucucuucuuauccauguaagagauuucuugaaguucuugaauaucuucuguuuuguacuuaaauaugaccuuugccaauaagugagauaucaugcuuaagaauuuauagauguguuucauacauacuugccaucaguuuaugugucuuuauuuuauguguuuuauuuuauguguuuuaucuguuuuugagauguguauguugacacauaucuuuuaugguauuauaguauauggauaacuaaauaguauuguaucccacugcuuaugaauauuuugaauugcuuccuauauugcgcagaucauuuuuauacuuccuuuguaaaagguuuucuuuagggaaaauuaaagggaugaaguuguuagaaaauaggauauauccuuaacuugauuagauacggcaaauuuuauguaaauuugauuugccaacauauacuguaucaccagugaaugaacauuuuuguuucuagcaucucuaaccaguacuuggaauaguuagauuuuaaauaaugauaucaaauggcaucuuuuguguuugcuuuaauucugagugguugguaaaaugauaagaguuuuaugauuuuuuucuacaugcuucaauuuaaugauuuuaauuaauuuuuuuuaagugcuggaguuugaaauccagggccugcuguaugcuaagcaauuuucuguguguuuuauaauuuacagaaaaaaauuuaaaagaaaagaaacucuacaagguuuuuuuuuuuguuucuuuuuuuuuuuugguuuuuuguuuguuuguuuguuuguuuguuuuuuaaauagcugauuaucuguccagucaucaguauaugggcuucuguaugcuuucauuuuggguuguuaugguauuuuguguguguguguguauacacacacacauaaauaauuauauauuauauaauagauauauaauauauaauacauacauauauauggauuuaacuuuuguuguaaauauauagcauucucuugauuauauaucuaggugugaguugucugggaaauauggcaacuauuuaaaacuagaggcauuuuaaaacuuuucucaaaguggcuauauauuuauauuccuuugaaauacuuuuauuaguaauaugugaagguucugauuuuuuucauuguuaguguuauugucauucucaguccuuaacugucauuguucauuuggggugcucuaaaguuuuaagaagaauaguuuuguuuguuuuuuaaauaggcuuuuauagauaaagagaggauggaaauugcagagcacaggaaaacauuucuuguggaauauccugagaagcaaaauuauuaggaccagaaauagagauuucugauauaugauagaguacaauaaccaagggagauugauauuucaggaugucaucauauauggguaauguuuggauuacuggaugugaccauaugacaaggacaucaguuaauauguaaaaaaaaguuugaaauuuauguuaacagaauugagaaggcauagggauuuuuuuuuaauaugagagggauaugaccaaauucuaauuucuaggaggauaguucugucaaauauguaagagagaaaugagguaaaaugacaagacucuguaucacaacaaucuuaguaaccauguggggaaaagaagcaauggauucuuucuuuaaagaugaaauauuacaaaaaagaauuuuaaagcuaauuuuuccggcgugacuuugaguuagacugguuuauaaggaaauggacauggauagucuuuugaaacagauugaaguuucuuagccuugcauuuacauagcuacccaaguuucuuuuuuuuuuuuuuucugugcuguuuuauucuauaaaccuuuuaaaacauuuaguauaaaaauuaaggacauacucucaauguuuugucuagucuggaaggaaggguauacuagcaggguuuggaaacauaguuuuacauauugugauggagcaauuaagcuauaccgaaagcaaguaaaggccacuggagaauuauuagggauaguguuggauuguggggagaucccugagguggaauugguagcagugagugagcaauauauuauauuuggcaggaugauuugaacuuuucugauuugagucauuggaacgagaauccuacuguuaugccacaggauuuacuaguaugugauaaaguuuaucuuuggggagaccauaguguuauaucaguccaucuaucaauuuauuaaucugucuguccauccacccacccauccaucauuuaucagcccauccauuugccuuuccuucuuuccuucucacucaccuaccugccaaccuauuuaccuauaaauaauaugcagauuuauuuauuuuguaguugcuuaauccauaggauuagguuuucuccuuaugacaaaauaagauuaaaagauauuaaaggcugaaaaauauucaagacaaguuauaaaugaacuaugaacacaaauuuaaaaucauaggagagcuuguuuuaagcucuguaauaaguacauuguuauuguuuauuuguaaagaauugugauagacauggagugacuuaguugaguaacagagcccuguuaugugucaggaaagcaucuauauucuuuuuauacauuuucucuaauucaacaacuuagcacucuugagagacugacaggucagaggauuuagccaugguugcuacucuagguuuuauauagcagaaguuuuucauauagagauuaccuggaaguggacuuacuguagauaucugaagggguuugaggaaagggauuguggagcauuacuuuuuguacaugaagaugggaaacauggcuuuccuagucggaaaauauucagcucacagccuacagagcuacccugcuacuuuucuuggcaauaggagugggguaauuugucuuucaauauauuuuuggaucuuuauaaguauuauugaagagaaauuggcuuuuauuuuauaaugaauuugaguaauuuuuuuucugaaagacuauccaguuuauguuaaaagaauugagugagguguuuuauauuuuagguuaaaaaaucucucuaagagccugauuuuagaguucaccagcuccucagaaguuuggcgaaauaugguauguuucuguuuuauuuuuugaaauucauauugcaugaauuauuuuaauauuacggcuaguauaaugacaaaugcguucaauaaauuugggcgccugucaauuuuaaagacucuuacuaggugcugaguauacaaccagguagacugugagggauauaagugggguguuggaagaauuugugaguuuacuguauuaugagacaaaguaauaugaacaagaaggucaaggaaauagacuuggcuguuaggcuguggguaugaaaaaucucuuucauuuauuugcaaacauauuuuauauaaggcacucuuaugauaacccagacuaggguuuuaauucugcuuuaagauaauugagguuuagagagguuauguaacuuguccaagauuucccuauaguaagugaucauggagaguggaaucuuagaaugucuuuggaaacuguucaacugaacauugaaccuaauaaagaggagacuaguggagaguacuugauuuaguaauccuaagaguauauauaguucuuuaaugaauuaguugauuuuauuuaagcuguguuaucuuuguguuuguaaguuagaaguuagauucauuucaguauucacauaauuccacauaagcuguuugaugagaaacuaagggaacuaugccauggaccacauuuauuucaaggauguuauuucucucccuugcuaguucagugaugccucuguucuuaguagaagauaaauaguuaugauagggaaauuugggaaauuggguuauuucuuaacagggguuauaaauccuauuuauugggacccccugauuuuguuuauauauauauauauauauauauauauauauauauauauauauauauauauaauauaaacuugagccaacucuaacaauaauauggguucaaauauugaugcuuuaauaauuccuuugggauucucacuacuuccuguuuuaaguuggguucugauuccgugcuuucagccaucuggcuugucugugcugucaauuugaggguguuaauugugaaggggcuuccucuuccuaaucuuacacucccuuuucuucuuucuuucuuucuuucuuucuuucuuucuuucuuucuuucuuguuuuguuuuguuuuguuuuaagcucauucaaauuuguucuauguuuauagaucagugaaagaggauuuugggggaaaacuggauaaaaccauaacaguauuggcauuuugucaggaguauaguaugauaaggagggcugugaaacgaaucagauuuguuuaaaaucacauaugauaguucagauaugugaauaauaggauauucauucauauuuugcuuuauauuacuuccuagaauugagucuuagugggauugaaaacgaaugcuuucuuauagauccaaaggucuaaaaguuaaugauagauuauacuacuuaaauaauuucugucucucugucucugucucucucucucucucucucuuucaugugugggugcguguguguguguguguguguguguguguguguguguguaaaacuuuaaucaagauuuugccuguuugguagcugauuucucccaucaguuaaagacucuugauacuaaaucaguuucauucuaauuacugccacaauacauagucuaaauuuuugcuuuuuguauguauuuaaauuacaaaacacuguaaagcaaaacuaaaccauagcaaaauucuaauacuuaguggaaauuuagcugauauugguuuuuuggucuuaauuucaacauuauuuacaaaaucuucggcaagucaguuaaucacucugaggcugcuuauuguuauucuucuauuuugaucuuguagagcuaaagucaguggaauguaaggguacaguugauuguuguauuuugugagccauauaguacuacauugaaaaguagggauuauuaucuuuaucagaaaugccugggaccagacuauguuucaaauuuaagaauuuuucagauuuuggcauguuccuauagacuuuacuguuugaacauaccuagucugaaaauucaaaaucggaaauauuccuaaauccagcccuuuuuuauuugcugccaugaugauuuaaaacauucuggauuuuggaguaguuuuggauugagaauauaccucauuuucucaaaugaagagaccauuuaagaaaacaauauacugaagaauaguucauaaagguuuuccugugauaauuauucuucuaauuuuauauugacuacugauuuaaagcuuugaagauaaugacuugaacaaugaauuggguuuaugcuaguguucuaacuaaagguuuguuuaauuuauuagaauuauuaagccuacguucagaucaaguuagcagcuagacuggugugacaaccuguuuuuaaucagugacucaaagcuguuaucacccugaugucaccgaauggccacagcuuguaaaagguaauuuugaauguuauuuuacagucuuagaaaggcugucauuguaagaugaauuaugugcuauaaaaaugacaaaaaugcauagguagcaggaauauugcuaagaauaaaagaccuaagaacggagccauuucuucauuuaaccuccuuucucagauauuuauuauagugcauuucuuacuuacccuucaguucaugaagauaaguaaucaucaaagaccuguuuuucugcauagauuaauaagaaaauaugucuuaaguauuuugaagauuacaguguggacauuuuaagagauauguggaaaauaucuuaaguauuauuuuuaauauuuuauguggcaggaguuucagugcuucuccagaaauguugcaccuuuaguaaaaugaguguacuuuuucuccuagagaguuacaguggaguuaaaagugcaccuuuaccuccuuaaaaggauggauuuacuaggucauguuccaguguucagauuauuuguuuugugauuacauuuucugucuuuaaaguuaauaccuaaaauugauacuuuuaaaagacuuuuuccucaccauuguuacuagguauuuuucagguuucaaauuucauucauuccuuuauuaauauucugguaaacuuuaggauaacuugggucagucuuggguugguaguggauuuuuuauuaacuuuuaguugguucuauauuuugaauuugguaaaauuaggagcauguccugaauucuuauuucaaauguauugucaguaaaaagcagcaagcauuuuaagagcagagaacaguuuuauaacuauuaguagguguuacauauacuuugugguuuguaacaccuacuaauaguuauaaaaauagaguuacuuugaaaguuaacucuaguuuuaggauauauuuuggcaacuuaauuagaauauuauuaaaauugucugcauagacauucagauguacacaaugaucagaaacaugcuuuuguuguauuuauauauuuuucucuugacuaaaguaaaacuguuugaaugggagcagccucugcuauacuaugucuaagagaucaagaagaguauaauuuaagaagaauaauuuguuuggauuaauuuuacucugaucuuucugggguuucuuaaauuuuaguuuggcuaaauggugcuuaauaacuuacucuaauauuugugaauauuaaauagaagucuaguauauuuacaauacuugguuggcauuauguuacuggcauucacauacucuguagcaaucagaaauugcgaaaauagcuguaguuggccauuugacaauauguuuguucuauaguucauuuuagggucuugaaacugcagcaguucuauaauauucucuugagauauaguucuuuuuuucucuuaucuuauauuuucuuauauaauauuuuuucucucaucauucuuaaccuucucuaaauuuuucuuuuccuguacauuuagaacacuuugcuuccuaccuguuuagagacuucuaauuuggcuuccuaauugcuaacagguuuuuguuguuguuuugcaagucagcuuuaucucacagucuuaauaauauaugagauguuggaaagacacauuccaaaaugaguuagcuagugcauggguuaccaucauguuuuaacucuucuagccauuuuauaugagauauaaguuuggaaacaaucuugguaguuucuuaaggcuguagagaucauuauuucugagauauuugcuuguuuucugggggaagaggguggagaauuuuuuauuugauaucacuccuaaucuacauuuuucaauucuuauguaauuuugugauaaacagaaaaauauaaauaaacuacuaagaaaaucuaaacugucugagcuuuuggggucuguuuuuaaucguaucuuuuuuccuuuuucuuuguguguguguuacugacuuggaaucuaaaugaauuacaaugaguauuauuuugaaagucaagcaaagaagugaaauuucuuugacacuaaagaagugaauacauuaauuuuuaagauuuuuuguuguuguuuuuuguuuuuuuaagacagggauuucucucuguguaguccuggaacucacucuguagaccagacuggcuucaaacucagaaauccaaugccucugcccuccaacuucuaggauuaaaggcgugcgccaccauugccuggcuaagauuuuuaaauuuucugugugugaguuuuacuugcagguauguauguguguaccagaugcacaugugcaccugauacucacauaggccagaagagggcaucagugcuggaacuggaguuugugaugguugugagcagcugugugggugcuaagaggcaaaccuugauuucucugggagcaguaagugcucuuaacuagugagccucuucuuuauccccuaacuuaagaaucauugcuuuaaaaaaucuuccauaaccauaagccacaaccagccuuuuauaaacuuuuuguuuaaguugaauaucugaagucagugauaaauuuacaaaucaagucuuuaacuugaaagacuaaagucaguaguaaauucacagauugucuuuguauacaaauuugaaaauuuaaauuauucuuuucuuucuuaaccuauuuugggaauuuaaagcauuagaaauagguauuaaaauaaauuuaccuuagaacauugauugucucacaguaaagauauguaggguaacagauuuuuuucuuuuugggaggcagugucucacuauguagaacagccuguccucaugcuaaauccugguuuagcauucugaugacaggaaguauagcaaaguauugcugugugcaucacuggaauuuguucuuuaaccagauguucagaauagggaaauuggcuuauguuccacccaauaaaaaugggauacucuuuggugcuuuauauguauuucuauauuagcuaauauauuaaaaaauaaagaaaauaaccagcagauauuaaaacuaaaacuagccuacaauuaucuagcaaacauaaugcuccauauacacggugacggcagauagugcuuuuuagggaaaucuaauuuccuuauagaaccacaggaauuaugauuagaauggugcauagcauuuaaauaucuuaaagaucuaugaacacuguuauauuugaguuuaaauugucuacugcagaaauuggcagacauuuuucaagggauuuuuuuuuuuuauaauguuuuagguuuugaaggaaauaguuuuuucugcaaguacuuauccuugcuuuuucugaauacauagacaguguauaaaugaauacaaaucucucaguauaauaucacuucaaaauaaaggugauuauccuacaccuuaguguuugcucagguuacaguuugcaaacacuucauuuaauuucaagacuaugaauaccacaacccaacuuaauagaaaguaacagucuuguuuuuuaauauguguuugacauuguaaauaauuauggcuuauacuaauuugauaucuaaauauaaagauuuuaauuuucuuuuuaaacauugagguuucuaaaauuuguucuuaaauguguugugauaaucugaucuuucuacuuuuuuuuucuuaguuuuaaaucuuuuaaagcacccuuucauuggaauuuaagucuuguuuuccaguuuaucuuccuuacuuauauuucuauaccuuuuuuuuggaaaucacuaauauuugucuuuaauuacauuuuacagaucaccaggagaaucccagucugaggacauugaagcuagccgaauguaaguauaacuucguucagguuauuuugugucucaaguugcccuacacuauuuuauuugaaaauaccuuucaggcuuaaaauaaaaaaagguaaaauugaauuaaaaaaagaaaaagaaggaacaacuuuaaauuguaucuagagauuggaacaugucuacuuauaucuccuaaccaaauacuuccaaaccucugcaaaaaauuagaugucuaaugguaaguagauaauuacauacaugauucugaauuuucaauguuuuuugugcccuuggcaguuguugauaaauaggggaauuagaggaagauucaaacaucuaugugccugcuauuaauuuauaauuccugaaagcaagauuguuuaaauaugaccccuguucuaaauauuaaucaucaggugcuauguuuuggguauaaagaugcuugagacuuauaucucaaugcuucagaaagagcagaaucagauuuuuuaauuauugagauagaauuauacuugguauacagugggaauacagaggaguaccaaauuaugcaaaagaaaucuagugcauaguaggaacauugguauagcugaguaaaacuagguugaauccugaaauguuacuggggauuaagcaguuggauauuugaacaguguucuaggccaagucauugccaagguucugaagcaagacacuugaguguagggaaaaguaggaaauugagaaccuuuucaaaauuugacaaugaggaaugaaaaaugaaaauaggaauaacuagaaggaauuaagcaggggacuguggcaaagacuuggugaauauagcacuugcuauguaaguauuaagaagacuggaguaagaggcaagcuggcugcuagguuagcauaauugacaagcuuugaguauagugaaaacaagccucugacuucuaaacacaccucucuacauguauaaaucuaccuauaccaucuauguuaaugcacacacauaugcauuccugucuuaagaaaugaggaggaaguaaagauagauguguauagcuauguuuaaggugugguugaaaaaguccagguuuuccuuacuagaagcagauuacaucccuuuaaaugcuuaaguacauugugaagucuuaagaaacaacuaugaauuauccuuuaaauuuuugagaccauguaacuucucugauaacuuuaaaacacuuauaaaauguauaaaauuuacucuuuauuguucuaaaguauaugagccagugguauuguaaauauuaauauguuugagcauuugucaucagaacuguuugcauuuugcccuacugaaacuuuguaugcauuaaauagugaccuguuucuuccacuguggcuggcaauuaaauucuacuuuuugucuguggguuuggugcuucuaacuaucucaaguaaguguagucacacaguuuuuguuuuguuuugaugacuggcuuauuuuauauaacacaguguucuugaaguuuauguguagcauauacuagaacuuccuccuuuuuuuuuuuuuuuuuuggcugaauaacacuugcuugcuuguauaugcuauauucugcucauuuguuaauggguuaauucugugcuuuagcaauugugaauaauguugugauuagcaugggucuaaucuuuugucaaauucuuuugguccuauagaauaucaugguaauuguauuuuuaauauuuugagaauauaucaugcuguuuuaaacaauagcuauaccauuuuacuuacauuucuuagaauaaaaguuuuauacauuuuuuuuuuacaacuugacccguauauuaaaauuucuuuggggaacaauagucauccuaauggaugugagguuauauuuuauuguaguuuaguagccaaauaacuuuuguuguuguuguuguuguuuaaaagaaaacucguuuauuuuguauaccuagauagcugcagguauaguagaaacuaaagaacugccuuccccauguaccuuuuuucccccuccccaucgagauaggguuucucuguuuaacccuggcuguccugaaacuggcucuguagaccaauuuggccucaaacucagagacuggccugccccugccuccuaagcgcugagauuaaagugugugccaccacaucuuugcuccccauguacuuuuuuuuucuuuuucuuuuccuuuuucuuuuucuuuuucuuuuucuuuugaaaaagguuuaaugauguuuuguggaacacuauaguuauaauugaguugagauugaguguacugaaaacuuaccaagauaugaaggguuuuaaaaaaacagaccaaauguugaaaguuucaugcacugaauggccugcuuaguuuagaaaccucauagugcuugcaguuagacuguaccaguagucucuaauagauaauauuuuagauugaauauuagcagaauagauaggacaaaccauuaguaguguuucauguauaacacuuuuagcauuagagcauuuuaaguuugcaugcuauuauugauggccagaguugagaauguugugucaucagaagauggaaaaaucaggaauuaagucuuuugucacauaaagcccagaaccuaaugauaucacugaugaaauucacuaaaccuugaagaacuaauacuauaaguuaagucauuacucucauaugaaaacaaaagucuaguacuauaggcuaguaacaaaaguucuucagaaaggaauaaccaacugaauuaaacaauacauaauuauuauucauuauaauuaaguggaauuuauuuuagcccaguauggugguguugcaugccuuuaaucuuuaaucccuugggaggcagagacagucaggaggaaguucuaggacacccaaagcuacaucaagaaacacugucuugaaauccccaaaagaaacaacaucagcuaaaaucaaaacccaagucugccuaacuacaggggccauauugccuuacucucugacucaagcauucuugaggcugcaagguggcucagcuauuaggagcacugaccacucuugcagaauaaaaaaaccaguauguuaaauaggacaaaguuguguccuuaguuaauauccucuuuuaaguaucaccuaauauauuaaaacaggaaaagcuuuuuaauuaguguuuguaaauuuuguuuuaaaaacauaacuacaaaaaauagacuaaugggguuauacaaaacaauagcuuucuacacaagaaaagauauaguuaacagauaaccccccuauggaaugaaugaaagcauucacaugcugaauaguuacuuuaugaaauguguaauucagacagcucauggaagaaguggauaggggaccuaaauaggugcuucugaacaaguaguuccgguaggaagauagcucaguagguaaaaugcuugccuaagaagcauaaggaccugauuugauaacuuucauaacaacauaaaaaugcagugugugguaguguacacauaaaauuccggugcuggggaggaagauccaggaggauccauggggcuaaucugauugguaagcucuaugcuggugaaagaauguggaacuggacuacaguccagaggaugacaaguaaggugguauagaccagacaggggaaaaaaggaguacaaauggcaaagugguuaaaugaguuuuuaaaaauuauuuugauauuauaauauuuuuucuuuuccucuauucuuugcagaaucucaaauauuucaauucuugcucuuuuucuguguugaggaaaaaccuauuuauuuauuuuuguuuuuugagacaaguuuuucucuguguagccugaguguccuggaacuugcucuguagacaaggcugacuucaaacucagauauucuccuguuucugcuuucugagugugagauuaaagguguuguaccaccaugaccagcaucaaauucaugagaaaaaaaauucuuuaccuuucuaaucaucuaagaaaugaaacaacagugagauacuacuuccuaccugcuagaauauaugaauguucauguuggugagguuguaagcaaacagaaaucuuguacacaguuguuuggaauguaaauuagaucgauuauggaaaauaacagguuccuaaaaauugcaaugaccuagcaauuguauuauagaaauauauaguguguuauaagagauaccugcaguuuaauuuugauugcagcauuaauuaaacaaaaugcagaaauaaaccaguguuugucaguggcuaaacaaauaaaaauugacauauaugaugauguaauuuuucgccauuaaaauuuuuuucugaaaucuuaugucggugacaacauggauggaaaugauccuuuauauuuucaaugaaauaaaucagcacaaaaacagguagugcaucaucuuccuguacauagacuguaaaaacauucuaaaaauuguuuguuacuuagaguagaauaaaugauagacauaaaaaaugcaaaaugaauagaauguaguucaggaccaaaauuguagagcauggugacuucuuucuguauauuuucuugaauaucacuaaaagucaacuauuaaguauaugugcaaaagugcuauguuagaauuuauaaacucauuugauguaucacuuuugcauaugauaauauauguaguucuuauuugucaaugaaaauaaaaacuuuggaaaaacagccgugucuucauauauuaaaauuauuauugcaugagugaguguuuuuaacagacgaauaacauuuuaauaauccuacauaugguguuuauuaugcuuaagauaaaggaguuaugguuggaaauaaagagauuguaaaguucucuuauuaagaaauacaaauaauuuuggagacucuuaauacugggauauaacaugcacauugacauugauguccuuuagcccaugaguuuaauagaagaagaaagaaaaccagaagauaucuagguggauuauaugaaaauuucauauuaugaauuugugcauauagaaguauuaagaauuuugauauuuggcuggguauguuugcuugcuccacuucuguacucccgguacuugggagcuuauucagggacagcuucgccuauacaguaaggcaagucaaaguuacaugagaucauggcuuuaaacaaacaaacaaacaaacaaacaaacacaaaaagcagcuaaaagcagggccuaaagaguuggcucaguguccugcuuuccaacuauguggacuagaauuucagaaccuauguaaaaagugaggcaaggccuuucaucccagccuugguggaggggcagaaauggaauggugguugaaauguguucauucagucuagauaauucagcaagugucagguuuagggagagaccacgucuuaaaaaauugugugaggagcauuagaaaauuaugaccgccuuugcuuucuggucuccaaaugcacaugcaugggcaugcaugccuccauguuugugugcacaacacauguauacaccaccccccaaaaaagccagaaaucaauucauccaaaauagaacuguuauuuguaugcuaucaaucccuugaaaucugauagacauuugcaucuuauuuaguaggacuuuauuuuaaaccaaauucuagaaagcauccuuaguuucucuuugugucacauauuggaacuguuugcaaguuauguugcauuuaucuucagaauacauuucagcuucuuuaaaaagcauuuguaguaccauugccaucuuuugauaagggacaucauuguuucucaguacuuuuguuccuaccucuauuuacuaccaacaauucaaugggcuuuucugauuaaaaaaaaguuaagccaucuuuucuauacucaacuuuucaaagguuuccuauuucuuaaacuaugguuagaaauugauacagcccugaacuggcucuuucauuuaugugacauccuguacuagcauuauguucuuaaccugcaacuuuugagguuuuaguucuggaacuuacugacuguucccucuugaguuaaucuacguguuuuucuuuuuuacuuguuucagaauucuuagauaaugccugucauagguaucuuuucugaguaucucuaucaaaauaugauugugucccaucuucucaauucuuacuauuuuccuuucugagauuuaguaucacuucauuucuuuuaaggucucaguagaaugggaaccuaauguucuguuuauauuuaacagucuaacaaaaagaaacuuaggggaguaaaggguuuauuucagcuuacauguuauaggccaucguucaaaguagucagggcaggaacuuuauacuguugcugacucaauuuucagaccuaagcauugcuaacaccacuuacuuacaguccaaaaccaccugccuagggaaugcuauuauccacaguacacuggucccucuuacaucaaucaagaccuuccccuuucccccagucacacccaugggccaguuuaaucuagguagucccucaauugagagucccuuaggucacacuacacauuagacuaucaaauucacaacuaaagcuaccuugaauacguagcaaaauauauaaggaauaguuaguuaaugaguuaaugcuugcuuacuaaguguuagugaaaaaucauuaaauguaugaaaaauauuuagugucucagaaauauauugugguagcaguuuauuucuaaauaacuauuacauauucucagccugugauuaugagggauaauacauaacaucuuaagaauaugccauuugacaaaucacuuugccuuguugauccuugaauguuuuuucagaauuuuuuaugagagcugaacauuuuuaucagggugacuucugguuauaagaucggaugcuuuuaaguuucugugugaaacugaacucuaauuauaggugguucuauuuucaaaaauuuuucuggguuuuuugagcauacucuuggucagauugaaccuuugaagguucuuuaaccuaagauuagccuucuaauauggagaagaaaucugagaaguuuuucaucaaagucaaauaacuagaggaauaccaacuaaaaaaaguaagcaauaacaaaagagaaauuagagauuauugagucuguaauuugguauuuuggaagauacaaggauuaguuauugggucaugcuuucacuauauauaguuaguguggaauaguggagucagugauugcuauuggaccacagaaaugauauggaaacuuugggaaugaacugugauauaacuaaggaccauugguugguuauaaguugaauaucuccugauuacuuuucucgucagauaguuugcauagcauugucaaguuguacagauccuaguuaguagagaucaagcuucaaggugaguuuuugcuuaauuuuuccauuucuuuacugaaguguguuauaucuucaguaguagugucuuacugucaaguucuggagaguaaccaaaaacuauggaaauaaauagccagcauuggaagagagugaucacugggaugucacuggucaacaauucaagagguugaaguuuaauuuuuuuuuuuuuuuacaaaauucuuuuuuccuuuaaaaaaauuugaaaauuucaucuagucucuaaaugaauauaaucacuuccucaacuccuccucuuacagcccucucaacccuuccauuauuuuaagauuauacuuuuucaaacuuuuuuuccuuuauucuccauugagucuaguuuugcauugucaggcuagucuuggaauugggaccugcuguaguguguagucagauuaccagggguucauaagacacuugugguaggaugacaucucuacccccacccccccaugcugggguuuuggcuggcuguagcuuggguguauuaucguaaugacuugucauaaguucauauaugcaucuagucucuugcucuuggaaaagacuguuuccuugaaguuauuuaccaccugugagugaccaucuuuccagcucuuuggggugagauaaaugucugauuugggauugagcacuuaacacuuucuuuuucuugccaugcuuaccaguuuuggaauaggaucaucucuguuacuugccauauguuacggagcaaagcuucucuagugaaagcuaaaauaaugggcuuuucucgggauauagcaauaaucauuaggagucauuuuaauauuaugugcauuuagcagaguaaugguauggguucuacccuagggccuauuaccuuaucuauucacaaguucuuggcuccuuuaauaguauggccuccacuuuauagaguagaccuuuaaugcaaucauauaguggcuaguuacuccuaaaacaccuaugcaauuauuaguaauccuaucuugucaggccacuuuuagccuucaggguucauaacuggaugagauugaggccuuuauucucaagagaguuuauauagcacuugccagcacaguggauuauagccaguugugauaaaguuuuccagugaguaccagcauaaugucuccaugcucugugauucaaggaugugguuggugucuauagcaaucugaucuuaccaucaagaaguuuucacuucgauuucauuacuugaagugucuguuuuuaugucagcaccaugcuguuuuuauuacuaaagcuuuguaguauaacuuaaaaucauagaugaugauacugauagcacuucuuuuacuauucaggauuguuuuucugucauguguauuaugaaauaaauuuuaguguuucuuuuuaugaaaaaucaagcuaugauuuugauggggauuauauugagucuguaaauuguuuuagguagaaugacuauuuuuacaacauucugagcaugggugguuuuuuuucaccuucugguugcuuuuucaacauauuuucuuuaauuuuuuaaaauuuaauuauacaacucuuguacuuccuuaguuugauuuauucaaauaauuuuugagguuauugugacugggaugguuucccuaauuucuuugucuuuuuguuuauuauuuguacaaagaaagacuacugaguuuugugucuucauuuuguauuguuacuuugcugaguguuuaucaacuguaggaguuuucugguagauucuuacaguuugcuacuuacaggauuuuuuuuuaauagaaccauuuuauuguaaauaaagauaauuugacuucuuuccugacuggugauuucuuuaguuccuucacuuacaguauuucucucaucagcacuucaagcauuauauuaaccugaaauaacaagcacaggcccagaaugugcuuguuuuguuccuaauuuuaguaaggaugcucugaggguuuuuuuuuuuuuuucauuuguuauuuaacauguuugccaggaauuucuucuguuuuuccuuuauuauguugagauauccucuguguccuaagguucucaggauuguguuacuugauucaccuacauguuucugcaguucucauucagccauuuguuuauauugucuuugaguuccuuuaacagggauuugcuguuugaagauauuuucuugugcaucauuuaugaugcuuuucucagagaugaauaaacuguggguguuaguuucuagaggagauaauugucucuguguagcccugacucuccuugaacuagcucuguagaccaggaaggcuuugagcucacagagaucaccuguucaguaauguguuauuuaguucccaugguuucuguaauaucuuuugcuguuaauaucuaauuuuauuccauuguauucuauacaaagaaguaugguauuacaguauucauauauuaugacuuuuucagugucuugauagguaguugauuuuuguagaaaauuccauagacugagaagaauguauuaguauauggguggaauguuguacaaauaucuauuacauucauuugacuuaacuccagaguuucuguuuuaauuuuuguccagaugaucugucugcuggagagaguuggguagcgaagucacccacuaucagucacuguugagacugacacgugguuuuagaucuaauagcauuccuccuaugaaauugugcgccucuguguugcuuaugugucuaaaauuguaacauccaccugguagauuuuuccucuaauuuucuuuauuuuguaucuuuggagaagggauuaauuaagaccauuuacaaucagaguucuugaaagauguguguuuuuucuguuuaucauggaaaauuucuauuugucuuugaauuuuuguguaaaguuuuacaaguguaaugcuuuguguuaccaguugugaucuuucaggauccaggcuagcuguuuucagccugagagucauaacugccacagggguugcguaucagauaucccgcauaucagauauuuacauuaugauugauuauaguagcaauaguuacgaaguaccaaugaaauaaucuuuugguugggagucaucacaacaugaggaacuguauuaaagggucacagcacuaggaagguuaaggaucacugauccagacacuucaugcuuuaaagacuuuuguugaauagauauuaauuuugaugagccugcuuuaugagugaugucacuuuuuucuuguauccuuuaguauccuuuagucuguguuuuauuuauuuauuuuuuaacuauaauauguugggaagaauuuauuuacuggccuuuuguauuguguuuuucuaggcuuuuguccacacaucucuacuugcaaauguucauugcaaugaguuauuggucuauuuugaggccucuagguucugccguauuggauccucaaccaggacuccuggauauccuguuguuacccugugucauggagauccugcaguuuuggaugugcagaacuggcaacuucauaaguuccagcagaucauaauuggaguagauguugggguaggcccugggucugugcuugggagguaguugaguuauuuuucucagccgaggucaacucucaagcacuauccugcuuaacuuacccaaugaagcaggaucagcccuugugcucucaauguccuugcauccagcuuaccugcaacaucaccauagccagcuuuucugagcuguuauagucaauuugcaggaccugugcuccugagugauucaaucaguaagggaaagggccaguucuaccugcuguagguagugagagggggguagaagaaggcaucucucccuaccccaugccgucccaccucagauguggggcuaaagcagaucuccaguacauaugcccuuggguuggauuguucuauuuuuaucacagaagaguuuuacaauguugaggaagagggcuaauuuagugcaggauuggaauaucaguuuauuuggcacgugccuuuuuguucuuagacauucuagauacuaauucuguuagauguauaguuuucugcauuaaagauuuucuuccauuauuuugguugucucuucacuacugauuugccuuuuaacuguugcagucucauuugucaguuuuugcuauauucauuucucucucucucucucucucucucucucucucucucucucucucucucucucucucucucugugugugucugucucugucacucugucucucuggguuucuugggaucuuuguaggguuauauagaaaagcccugguuaugucuuucuuuuugcuacaaguguuuaucagaguccuuaaguaaagaaugcuuuuguguacuuacagagauaauuuguucuuuucuuucccauuuguuuuguucugguuuuucuuguuuucucuaugacuucagagugcuacauugaauaauauuauagaaacugaacacccuugucacaugucugauauuagagaaaaaugacuucaguauuuuuuuuuauuuaacauaacaauagucucagguuauuuuauagccuuuuaguauguuugagguguguucuuuucuaagugcucuuaccugguuuggaacucucaaaauaauauuuuuguagaauggcuuuaguaguuuucauucccuguuugguagaacacuuugagguuuuuugccguuuguucuucuauaaagaacugguaauuuuagcaaugaaucuauucuuugcuuuucuuuauugguaggauguacugcuucaguuuuguugcuuucuguaucuuuaguuuuuuuuaauuuccuuuuaauauaauuuuuauagaucauaccuguugaggaauuuauaacuuucuucuagauacuucauucuuuuuaaauguugcuuuucauauuaauuacuaaagaccucauguguuuucaguacuacauuuuauuuuguccucaucuuaaccuugaauuuuauuaauuuggucuugccuuucuuugguuauuugggcuaaggaauuguuauucucuucaaagaaagaacucuguguuuuagaguucaguacauuaauuucuauacuggucuuuauucuuuuuuuuuuccagguauuaguuuguaguuuggguuguucuuauuuuucugagauugugaugugcauuguuaaguuuuuauuugaauucugaccgaauuuucuaaaggaaggagugaaacuucacuguuagagaugccuuucuguaucauaauauauuuuccuuucuugauuuuuuuuuuaacaugacaaaauaaaauacaauaagaugaagcaaaaacuaucaugguagucugccuugguaaacaagaggaaaagagucacaagagcaggcauaagagucagaagccuaauucguucucacaccagggaguaccauacaauacuaaaccuauagcuauuuuacauguguguuugugugcacaugcgugugugccuauguguguguguauuauauguauauacauauuuguaguauaaauauacuacauauauauguaauacacguaauauauguaauacauguaguacauguauguauguauaugcauacauauacaugcauacauacauacauauauaauacacacagacacuuacaaauacauacagacauacauacagacauacauaccugguacagacccacugcuucaguuuaugacauuuccuaugagacuuucguaguugauuuagagggucuuguucugguaucguccauccccucuggcucuuaaaguuuuuccaccuucucuuccaagggcuucccugcucucugcuguaaaguauuugauugagagcucccauuuaaauauucuguccauguaaugucugacuguggucucuccaucucugcaccuguuuccaucugcugccagagaaaaccucuuuugacaguaacuagauuaggcacugauacaauguguauaccauaaucauuuuauugacuuuaaaauuuuuuaagauuuaaaaaaaaaauuuaaaacguaaguaguguuuuuguuuuacccuagguuucugguucuuaguuauccaagcagucuggauauaggcuucuucucauggagugggccuuaagucaaaucagacauugguuggcuacucccacuaguucuuugccccuacugccuuagcauauuuuacaggaaggacagauuguaggucaaagguuuuguggcuggguuggugugcguauaucucuuuugguagcuuguagaguaccuuccuacaccaaagaaguagaguguaggggugaagaguccaugcaggcagcagcuuggcuucuccguguucauuggguaguguggauauuguccuuagcaguagggcucuacuguuaguuuucagguagcaaccuguuguuuugacaacagcuuaggcuguuuggggauuauucuuucuuucuuucuuucuuucuuucuuucuuucuuucuuucuuucuuucuuucuuucuuucuuucuugucgucuucuucuucuucuucuucuucuucuucuucuucuucuucuucuucuucuucuucuucuucuucuucuucuccuccuccuccuccuccuccuccuccuccuccuccuccuccuccuccuccuccuccucuucucuuuucucccucuuccuccuccuccuccuccuucuucuaagauuuauuuauuucauauaaguggguacacuguugcugucuucagacacaccagaagagggcauuggauccuauuacagaugguugugagccaccauaugguugcuggggauugagcuuaggaccucuggaagagcagucaguggucuuaacugcugagccaucuuuccagcccuguuugggaauuucuaugggacccucuucacuuaacugaagugcaacucacuuugguugucuggagacaagagauggccacuuaagauucuauaucuuccauuacuagaccauuuuauuagggucacuuucauacauucaaggacauuuccaaugcacuagguuucuacaccaacauggaaauucuuuccuccccaauuccagcuguuucuaccacacuuucccucaaccccaucucucccuccaccugcucaccuccccacaccugcuuacucucccuaucuacucccaguuggcuguauaaucuauuucacucuucuagggagauccuuguaucccuacuggauccccccucuuuaccuaaccucucuggcucuauagauuguaccuugguuauuauuuacuuaacugcuaauauccuuuuuuuuuauaagugaauacauaccauauuuaucugucugagucugaguuacuucacugaggaugauuuugcuguuuccuaguguguuuucuuuucauuugacuuauuccuuuaaaacacuucuguucugauuccuucaguuacucuuaugauacuuaagauuguauuauauugucuucagguauuuguagcauaccuaguuuuuuuuuugcauuuuaauuuuauucucuuauuauuuguuaaguacaagaaaguaauuuuuacuauuguugacuugccuaauguucaaaaaugugguuuaucucuuagagaguuccaugggcugccaagguuuauucugcagaaggugagauguuuuuuagaugucuugaaauaaguccauuugauguuugguacaguuuagauaaaaucaaucuuccuuccuuccuuccuuccuuccuuccuuccuuccuucuuuccaucagauaaguuauuaauuuggaaaguuaagauuauuacuguauuuuacuguauuuugacuuguuacuuucuauauggauauuguacuuucuggugagagguuggauuuuuuuuuaagauuuauuuauuuauuauauguaaguacacugcagcugucuucagacagaccagaagagggcgucagaucuuguuacagaugguugugagccaccaugugguugcugggauuugaacucgggaccuucggaagagcagucgggugcucuuacccacugagccaucucaccagcccgagagguuggauuuuacaguagucugguagugcuuguuuuuaugaacuuggguacaccaucauuuaaugcauauauacuuauaauuaauuguacaucccucauugguuguuuucuuuuuuuaaauauuuuuuaaaauauuuuuuuagguauuuuccucaauuacauuuuuaauauauuuuuaaagagauuuauuuauuauuauauguaaguacacuguagcugucaucagacacaccagaagagagugucagaucucauuacagaugguugugagccacccugugguugcuggaauuugaacucgggaccuuuggaagagcaguaggugcuuuuaaccgcugagcuaucucuccagcccaguuguuuucuuuuauaguauacagucauauacuuaugucaguaguccaguucuuuuuugauuuccacucacuuuucagucuccuuuuuuuuuuccuuuagcuucuguucaagugaaauacauuucuuauagacaacaaauaauuugauccugcuuuuaauucauuuggcuaaucugucucauaaauggaacgcuaaaaacauuuauauuuuguuguuucuuucauuguucuguuuuucuuucauuaacuuauguagacacaguugcuucuuucuuaauuuuucauauauagaauuacaaaauucauuuuccuugagcuccucuguuuguaucauucugcuauguguaaguuuccuuuaaguguauacuguaguuuaguggucacaaguggccuuauguuaugccuaccuuggaaaguuuuuauauuacauuuaaaagauaacuuuggauauaguaaucauugaaaagauuuuugucuuuaaaaauuucuagugagagguuggauguuacagugaauuuaccuuuguuaguauguugauacuuuuauuuucuuuguaguguuaggauuugagcuacacugugcucaggagcaauucuuucuguccaugauuuauuuggguuuuacacaucuuucuguauagauguucauuucuuucucgauauuuuagaaaauuucugcuguuauuucauugacuuagucucagugcuuuuaaguuccuucugcuccauguauucuuuaguuucauuuugaucauguucuaaaagguuugguuguguuuacuuauuguguuguugugugucugaauacagauuuuucuucaauuccugcuguucugucuuguacuugauuuggucuauuauuuaugguuuccacugagauuuuuaauuauuuuauuuauuuccaucauccucccucccagcaccagucucaauuucuuugcuaaacuucucauugacauguacuucagaauucuuugaacagcauuucaaacaguuggccaucuuuuuauugguuauuaaaugcugaucuucugaaauaacuuuguuccauuuauaauguuuuguuuguuuuuguguucuaauuuguacacuugucaguauggauauguuuuccaguuuuauuuguaauuagccuucuguugaguuuucaauccuuaacacuacucaaaggaggaaagaaaccuccaacacauacaauaaaaccaaacaauuuucagauauagacuuugaauugauugaugccagcauuuauagcaccauugauaauuaaaaauauguuuagaauaauguaaguagucaaaacuuguuuagggucaaauuagaaauagcagcuuaaggaaaaaaaaaaggggaaaggggcaggaaaagaaaagggaagcaaguuuaaaugaaaagaaguagaauacuaagaauaaugggaauggaacaaauggucaauaaguaaagaaagcaaacaaaauagaaagcaaacaaauaaauagaauaguaaguaaauaauagucuuacaaaaaauaaagucuaaaacaauaacaaguaaaaggaaguguauuggaguaauuuauucugcauccccuaauauuccaguccuguuauugaggcuggugcugauuuggaaccagucaaagcucagaugucauagaaaacuaucuucgguuugagauugucaguguuuuugaauaccagugucuuugcuagcugaacuuugcuguacaggaccuagggauuuuuacauuuauuuuuuaaauuuucaccuauuuauuuauguauucauucauucacucauucauuauuuccuucagggacuuuccagcuuuucugucuuaguuggcuacuuucaagccacagggugucucccaaguaugcuuuaaaugagggaagucaaaaaagcacuguuuguucuagagaacuggucucuauacuuuuagauccugccugucgucaccacauugcaagggguaucagacagcuggaaucaauuucuccacuggaccuuaccuucagaguugucaaguacuguaggcagcaacccucaugacagacagagccaauuuuguaggcuugacacuuuauccuccacauuguaggguuugauccuugccacagaagggcugguuaauugacacagugcccuucaagccuugucuacuuugcuugaguuucucagucaaucaagucucuacuccauaucuaccugacucagcuuucuucccacccauagacuauggcaagacuucaccccuuuuccuuauuuguaauuguuucauguuuuucaacccccaagauuguuuguuuucaaacaaauguagaucccuuuucaugacaccugacuaguucuccagaauacaguuauaaacuggauuuuucccuuuccagugcugacuuagaauaagucagugucaugacgaaaccuccaauuaauucuuugugaguacucuugcuuguucugugaucaagacuauugcauuguuuuagucagucccaucuguuuuaccuuauggaugagauaucccuuaucaccaccacuuggcuggagccacuugcugcuuuuccuuuuugcuacauaguauuuuucucuguuucucaguuguaguaucucuuuugugauuuccaauauucuucaucucucuuagaauuugaauuuauccuuugauacucuggaaguuuucauucacuuuaucacauuagcaccuuguagucuugcaucuuauuccaaauguuccuguaucuuuuaucuuuuucuuaucugauagcuaugccuagauauuguacuucauccauuagaggugguaagaguaaauauuucuccuccuccauuucuucuuccucuuccuccuccuuuuuauguuuaucugugguuugcugggauauaucucugugcaccacauguagcauggucggugcccauggagaccagaugaguguguaacuccuccaggugucacagcugacugcaccaguuuguugguguggagaaucaaaucuggauuccuuggaagaggaggaaucagugcucuuaacuacugagauaucucuaucacugggagugguuauucauguucucaaaugagucugucugaaagccuuuuggcuucacaagauuucuuuuaaguaaugggauuuuagcaaggacauguguucuuuuucaaauguguuuugugcauugguuuugacuguauuuagauuuaauauguguauauguauauguguguguauauauauauauauauauauauauuuauauauauauauauaugcauauaugcauaugcaugcuauaugugugugggugccuguggcauuuaaugcucuuaagcuggaggaacaggcaguuuugugagccaccugacaucaugcuaggaacugaacucuguuccucugaaaaagcagcuagugcuuuugacuagugagccaucacucuagucuccuaucagguaucugcuguuuguauggcagugguacuaacucuuuccaaacuaauacaggacagauuuccauuuucaaaauucuuacuuaggaaauauacaaguucuaaaacuagcauucacuacaaucagccaauauucaccuucuguuuacagaaagaagagucaaccuaugguuuuaggaaaagaucuuuguuuaaaaaauaauauucuuugaaaguuuuauauauuuauacaauauauauugguggugugccucuacuacacuauguuuccagcuccacuagucaauuucuaaauuuguaaauguuuacuuacuuucuucuaaccaugaaacugggcaggugaaaaacaaacaaacaaacaaaaaaaaaaccccaaaaacagugguuuauucauuuuaaaagauaaauaauucuaugugaaaauuuaauuccacaguucuauuuuuacaacuaguacuuuguuguaaagaugaauaaaagcauuuuuaguauccauccauccacccaucuaucugucuuuaagaaauuuuccuuauuuuauauauaauugacuuucaaaugguuccugauacuaauugggucauauuuguacuuucagucuuguaauacaugauuugaugacacuucaauagacccuaccuuauacugguuuuaacuguauuaugaauaucucugguguuugugagaucacauuuuuuacucuugacaaguuucuacauuaaaaauaacuuggggcaaguugugaaauuugguuuacugauuccuccacauaaaguucauaauaaacucaagaucuuccugccuuagucuaguauaugcuacuauuauaagcauaagccaccauuucuuggaggaguagugauuuuuauaaagguacauccuuuauaaaaccccuuacaaaauaaugagacauuuaccuaugaaagacacuaagcagugcuuacuagauuaugcauggguuaauugagucuugggcuguauauguuucuuaccucuuuuguccaaucuuuguuuuuauucugcuuauuuuuuuaaaaaagauacuuugaauaagucauauuguuaguuaucucuuucauguuucuguuucuuguuuucauggcagcuauuucacuguuuuugauucucaugcugaacuaugugggaauucuuuauucuucuaguguauaaucuccuugaugcuaucuauauauaguuaugaauaucuuauaacuuuaucauuuuuauuaugauuuacuuacuauuccuaaguauucaacuaucccgaaauuaacuuaggacccagcaaauaauguuauuagugcuacugagaacacugaaaauuauuucucuuuauugucauuuguggaaaacaucaauuaguuauuaauuaauucuuucauauaguuuauccugucugcauuuucuucucccugcacuccucucaguucuuuccuccucccuucccucaugcuucagauccacuacccucuucuuucccgucauuaaagagcaggcuucccaugaauaucaaccaaaccuggcauaacaacaaguuucaauaagauuaggcacacacauaaccuucccauugaggguggacaaggcaagccauugggaggauaaaguucucaaaagcaggcaggagagucggagacaucccuuacuuucacugcuaauugucacacaaggacaucaagcuauacaaaacuauaacauaugcagaagacccaggucagacuccccaauuguugcuucagucucuguuaaccccuuaugagcccugcugaguugauucugugggcuauguuuuugugguguccuuuggcucccuuccccucuucagcaggacucuucaaggguuuggcugugggucccugcaucugcuucuaucaguuuccguagaauccguuuuaauggcuucuuagaaaguaauaaagaaguggaaacuauuauuuaaagaggaacacuuuuacugguaggauucacuugauucuuauaaacuaaauaaaaaaggcauauuuuuauuuaaggacucacuauauuguacuuugauuuccacgaagucaguggaauaugaauaggcaaaaguaacugcuaccuccuuuuuguagaguuuugguuaugaauaucaggaaacggauucacuucauuuccugaacuuuacuuugguuuuucuuuuauguuccuuccuacuuccccacucccuuuuuguuaaaguacuaaguaggaagaaagaaccuuacucuauucaucuucugaggacaaagagagaaaguaaggaggccagaugauugguugaaaguuucacuggcaugcacagggaauucauuuuaaggugacaaagcauuuuacuuuuggcuagauacauuaugauagagaacauacaggaaauauacaaguacuugaaauuuaccauguuacauuagaaauuauggacauagacauuuaaguuuuaugcaauuuucacacaugaaacaaaauauaauuuuuuaaugauuuaagacuauaaaauauucuaaacuucaacuguaaaaaaaguagauuugacacaugagguaugauuuagugaccaguccuauguauggauuagcauuggaagguuaucaaaagcuauuauuaguauguauguuuccaacuuuagaggccuuuuacauguccuuaaugaauuuauaugcccugcauuuggcauucaaugguaucauuuauaaugagaaaagaauagcuuauuauuguuaauuaaucauauucaaucauauuaaccaauuuaauuaacuuaauauuaauaaacgcacauuaaucaaauuagucaacuuaauaugguugauuaugaccucuguuuauuuaauuuaauauaauuauuaguauuagugggcuacuacuuguaacuuggugcaaaaaagcuggucaguuucaaacauuuucucugcugucuccccuuuaguaaugcuaaaauuucaaauuuuggaauuaagccuagauuuuaauuuuucagauuuagugcaauggaguucucuugaccaagucauauacucaugcaaaugauagaaauuauagcaauugcaauagcaucugauacuuaccauuagggccuagcauguagcagguaauacauacuauuccauuaauugaggauuucauauaugauacaaugcauuuugcucaucuucaccuccuauuuuuuuccuaccucuuccaaaauuuacugaaauagucuaaacacuuguaauucuuaaaucauuugaauucugaaauauacuggcauccuaaggaugaggaagcugagacacagaaagagacuaaauaaguaguuaacucagauacagaaacuguucaugaacccaaacaaucuggccucaaaauugugaauuucuaccuguuacagacugagucuucuuauaaagugcuuagcauauccauuuucaauaaauuaccgauaucuuaaguauagugauauaauuuauucaggaguuucuauacuguacccagauaguacacaugguuguuaaguuuagauuggaauuuuuuggaagauuuuguuuucuaauuauauauuacuuaggucuuuuuuucccccuuaaaacuuuuuaggacugcugguauuaagaauuaauucuucugaaauuauaaucuguaaaacagugauuggaaauaaauugaauucugaagcugaaaauuguccugacuucuuuaauggacauagcauaagaucaauuauaagauuugaucuuuucaggucuuucucuuuuacuagcuguagacagaagauaaucuucaaguucaaguuucauaugauaaucagaguaccugacaauguacugaguuuauuauuuggcauguagagagugcuagcuagacaaauuauaaggacauaaggugguaaaaugaggccuagaaaauuaguucauucaacuaauuacauugagcugacuuuuggauggucucauuucucccuucaguauugagaguucuuuaucacauaaagaaguaguguguguauguguguguguguguguauggguugggggggcggccuaguacucuuagaaaacuaguguuuugaacuuugaaauuaacgcuuaaaaauccuggauauaaacauaaacauuggcucuauuuaaaucacguagaugaaguuuuaaaacuuccguacugauacuuagaaauuuuuaguguuuagguacauacuuacagaaaaaacguagcuaggaagaauuaacucagucaauuauuuagaaaaauaguuaauauuucgaaacauucauccuacauuuauaacuugaucacuagcuuuuguuaaggaaguaacaaaauuaaaguaguugguaauuauuuuauuuggugcaugcugucaguauauugaagcgguuugcuguuguuaagcaugcugaguuuccauaaauaauagggaaauaagucuuccuuuugaugaauuuuucucauaagugguaucucuaacuucgugauacauuuuaaacuucaucacauuuauuuauuuucuguagauacaugugacugggcauauguuuugguguguuuagaguucagaggacaacuugugguaauuaguucucuccuuucaccaaguuggauacagggaucaaacuugagucaucaggcuuggccuuuguacacuaugcaugguaaauauacagggaauauuucuaaauauaaguaucugaaugaguuaggaucguaugacauaccauucuuugucauacaaagaaugacauaguccuaaagucacuuaucagugccauauuuguuuaucucuagugccauuagucacuuaguucuaucuaaaauaaugacaugaaguuuuagaaugaaauuagauagauucuuucuacuugcaguucccaugcuuguauagaaccaaacggauuccuuagaaugacauuauuaugggccagauauacauuucaacuuaaauuuugugguaaucuccaagaauagaauuuuagagucaaauuauagaauuuagguuauguagaacaacuucuuguuugguaaaauaauucauuccuuuaauuguauugguuacuuugcaugaaaaauauguuaaucaaauguuaauuuuaauguuuaaaguugaugaaguaagaugaauaugaguuuccccugauggaaguuuaaaccuuuaucuuuccuaugacaaggauuuaaugaagauagugacaaguaugggcucaagguuguaugccuuggugcuucucucucgguauaauaugaaauuagauaguuuauuuauaaagcacuuuuaaauaucucaugauuacuuacugaguaaaaaauuuuaaucucuagaaguuugauauuaacuggaaaucaaguauuugaaacuguuaaaaugaauuagugauuuuauauuagugaaaagggaaacugccauggagauguagcagugaaguuuguuuuuguuguuuucugcuaaauaguuaaggguccuauaccaucaacuuaagcuuaucuuuuuuuaaaccaaagaaaagccugccauauuaaaauuaucuuauaagcugacauaguuuaucacaguuuuuuuagaaaauguuuauuauuuuacuaacacuuugggagguaguagugaauuuccaguuucuacaucuaaauauuuaguuuauugcuuuauugcuuagcuaacuuuugccuuaucuguugggcuuuguuucugagcuauacuaauaaaugugcuuauuguuugaaugucugguacaggaagcgagcagcugcaaagcaucuaauagaacgcuacuaccaucaguuaacugagggcuguggaaaugaggccugcacgaaugaguuuugugcuuccuguccaacuuuucuucguauggauaacaaugcagcagcuauuaaagcccuugagcuuuauaaaauuaaugcaaaacucugugauccucaucccuccaagaaaggagcaagcucagcuuaccuugagaacucaaaaggugcaucuaacaacucagagauaaaaaugaacaagaaggaaggaaaagauuuuaaagguaagagauuauauuucaauucaaaaugguuaauugaaagcuauaucagauuuaaauguggaggggguuguuuauuuguuuugauuuuguuuuuuuguuuguuguuguuauuuuguuuuuauuuuuguuuuugcuuuuuuuaucaccuuaaguuaucgcacuauaauauaguaaaagucaccuuuucugguaaacugugguaaaggacugguauuuaguuuguuuacauuuuauucuuauauuuuacugauucauuaguugucagucagaagcaaguuauacucuaaaaauuaauaugaugaugaguugaacucaguuuguaaugauuuauauuguagcuaauaccuuauuaggucacaaaaaucuacuauguacauugcauuugccgugaauaccuaguaucggcucuagaacuccagggacugugguaaaaggagaaauacaaauauaaaguguaaaguagucuuuuuuuuuuuuucuuuucuuuuuuuaagaaagcaggguaaaauuuugcaauaguuaucugaaaauuacauuuuuuccuucuuacauucugcccucucuacgucaggaauuagauauuuucauacugcuuagggacguaacuuaccaguaauagucuuuacucagcucuugugggguuucguuucauuuuguuuugugcaaguuaaguggcacuauucuuguacuuuuaauacucacacuucuauuuccccaguaaugaaauuaaaguuuuauacucugauaccugguacugaggauagccucaugagugaaaaauaagcacucacgauuaagcuauguccccaaugcaucuaguauuuuaaaaauaguucuauauuuugaaaauucuucaaauuuccuacuuugccucaugauugauuuuguucaaucuauuuuuuucucuuaauggaaguaauugaauguuucagauugccagggauuaguuccacuaucacuugaaacauguuuaaaugaauuagugaaauaaaauuauaguacaacuucaugauauuacuuucacaauaggacuaaagaaaaaucagaaaaaaaaacuuucagcuuugcuacucaaaaauauauagccaguccuauuucaugaauuuguuuacauuguagauaaguaggugaaugcuaaucaauauuuugaaugugaaaauugcauuggcucaauuauacauguuucuacaacagaguggacaugacagaguaacaguaaaugaaaaauaguaucccaucauaguugaaugcaacuaacugugggaaaaaucuaguauauaauggauauaguugccuuguuuuagcccauggguguuccuuuuuuacagguucuuuguuuuuguggaucacuccaaauuuuauugccuuuacuucuuuaauauuuuugaauuauauaugcuuaaucauguuucccucaguuugauaauuauauuuguucacuuuaguuagagguguaguuaucagcuaguguaucacaacucuguuuuugcgugaaacuguuuggaguauaaaauguuauguuuuaaagauuuugagcugauuuccaguucuguuucuacuaugugaaaccaugucucaaacaguuuucaagcacacauauauuagaauguacaggugaaucuuaaaaaaaaaaaguuucuuuacuuaacuguuuguugauacccagauuagaacuuuuuauuucugauugcagugauuuauaugcacacaugagaggggugggggagauggagauaaacauuuuaaacauuuuaaguagaguacuacguggaacaaauaucaaugaauaguaguuuguauuacuagaaugucagagugauuuaaugacugugcucugaaaggaagacauugcaaaucaaagguguguggaucuagagcuuuauucucuuucaggcaggauguauauuguucuguauguagaauuugcacuuucuaacuaauuuuauaauucaaugauagggagauaaaacauuauauucuaacagucugccuauuuauucauuacugauauuuucuguguuuugguuacaguuuagagaaauuugguagacuugaaugguuaaagaagauuccauguauuuuuuucaguuagaauaacgagaaaugagcuccauguuaguguuuucuuuuuuacuuauucuuaguagacuaagaauugaacuuggcuugccaugcugccucagauagggacauguaacuacugaaacucacacuguagaaggagaaaauuaauucuuuuagguuaucaacucagcucaauacccucaucaccucuaauaaguaaauagaacauuuuuuuaaaagaaagaauugaagaucauaaaauuaaaaaguaucaauacucuagaaugggccauagacagguuuguaguauauauaguuuagugcuuugugguuuauguuuuggaagccauuccaucaaugaggacuugaauuuuauauuguuucuuauuuuugaauuagguaccuuuaauaauauguagcaaucauaauaaagauuuuacauguuagauauauuggcaauguaugagguguauuaucaauguaaccauaaaauuauccuaacuuaaauguuuaauaauuauaauauguuacucuuuggugaaagagauuagugguuucaacauuauuauuugauaaauauauuacuuucuaaaacuuuaauauguaaaauguuaccuuuuuccaaaaagauaaguaucuuuuguuuuguuaaccugaaaugguaaagccuuuguugaaauuuacauuuggccuaguggugagaagcuagagacuuuuaugaucccaauucuauuucugggagaaaauaaauauagguuuuagugcuugugguuuuugcuuucuuagcuucuuucuucuguuuguuuuuaaaugacugaugacuguaauaauuuccaguugcucuguuaagaauuguuagaaccugaguaauggucauagguaguaguaguuguaguagcaguuuuaacuucaguagaguuuacaugaguaguaauaucuuuuccucagccucugaauggaaauucuggaagaaauuaggaauacauaagaugagucaguuugguuuuaguauauacaaaaguauagaaagaguugauugcaaaugaaggggcuaaggaaaccuuguuauaaaaccuuaccuccuuaguuuuuugagaacaaugcaaaggaaaaugauuucaggauuuuauauaguagcuuuuuguuaagguuguaauaaaguacaaugaggaaaugacaaguauauauauuuguucauaccuacaauuaauguuacauaccaguacaugucuugguuacaaggcaugucuuaauuaucaaugcauaauuaauaauuauauuuuguucaaugaaugccaagaaagggugagauuguugggauuacuuguuaauaaguaaauuacaucauuuaaaaauucuaaaucaaguccagaauguuuagauauuuuacuuuuucacuagcaauuauuuuaacaaaauaaacauguauauuacaacauaaauguucuuuuucuuuccauuuucuagaugugauuuaccuaacugaagagaaaguauaugaaauuuaugaauuuuguagagagagugaggauuauuccccuuuaauucguguaauuggaagaauauuuucuagugcugaggcacugguucugagcuuucggaaagucaaacagcacacaaaggaggaauugaaaucucuucaagaaaaggaugaagacaaggaugaagaugaaaaggaaaaagcugcauguucugcugcugcuauggaagaagacucagaagcaucuucuucaaggaugggugauaguucacagggagacaacaauguacaaaaauuagguccugaugaugugacuguggauauugaugcuauuagaagggucuacagcaguuugcucgcuaaugaaaaauuagaaacugccuuccugaaugcacuuguauaucugucaccuaacguggaaugugauuugacauaucauaauguguauacucgagauccuaauuaucucaauuuguucauuauuguaauggagaauaguaaucuccacaguccugaauaucuggaaauggcguugccauuauuuugcaaagcuauguguaagcuaccccuugaagcucaaggaaaacugauuaggcuguggucuaaauacagugcugaccagauucggagaaugauggaaacauuucagcaacuuauuaccuacaaagucauaagcaaugaauuuaauagccgaaaucuagugaaugaugaugaugccauuguugcugcuucaaaguguuugaaaaugguuuacuaugcaaauguagugggaggggauguggacacaaaucauaaugaggaagaugaugaagaacccauaccugaguccagcgaauuaacacuucaggagcuucugggagaugaaagaagaaauaagaaagguccucgaguggauccacuagaaaccgaacuuggcguuaaaacucuagacugucgaaaaccacuuaucuccuuugaagaauucauuaaugaaccacugaaugauguucuagaaauggacaaagauuauaccuuuuucaaaguugaaacagagaacaaauucucuuuuaugacaugucccuuuauauugaaugcugucacaaagaaucugggauuauauuaugacaauagaauucgcauguacagugaaagaagaaucacuguucuuuacagccuaguucaaggacagcaguugaauccguauuugagacucaaagucagacgugaccauauuauagaugaugcacugguccggguaaguuugacuauuauuuaaaauuggaauuaaacuaaaaccuagacagugauguauuucaauuuauucauuuuaucuauaauuuuggaaaaaaauaggauuauguuaacauuucugaucuguauugcuacaccuuuguugcuucuuaccaaaaauacugguauccugguugucuaaugauaauucucuuuugaagaagaauagauuuuucuaguacuaggggaaugacucagugguuaaaacguuuguugugcaaacaugaggacuuauccuuggauuuucugaauacauguaaaacaggauaugguaguuccauuuguaauaguacugccuaaagcaagauagaaaguauagacagaaaaauccucagaagcuaaucugauauauaaacugacaaauaacuagacccugucucaguugguagaaagcaaagucugauacuugauguucuuugaccuccacacauacguuuuccccuuuuggcauuuacaugcacacaugcaugcaugcaugcaugcauacauaugcacacagaugcgcagacagacaggcacaaagcaaguaaaaggaauggauuuucugaaucuugaaagccagccucauauauuuccauuaagaagaaaagauugguuuucaaagauuggaacacaugacaaaugguauuguuauacacauuuuuaagaauggaagauggaauuggaagaaauaaugcaauaaauguacauuguaaaagaauaagagcugcucuucaaauuccauuauguguaacacaacucagcuuucuauugugaacuugaugauaugaccaggaaagguuagucuguauuaucaauaagacuuuggaguucuaagccacucugucuugugugacauuguaggauuuuguuuuuuuaaauaauaauaacaugaaucuugaaaauucuguaaaguggcuauuuugggagcuuggaauuaauguuaguaauaccagguaaaucuagaugauuuaacugggaagucaggaacuucuuacugcgugauuuuuguuuuuguuuucaaauaacauugccucuugucuuccuuuuuucuacagacgacaaaaauuacagagucccugucaguuaaaccagaaauuugguuugaaaauugucagucacauauuaacaaaauuauauauaaguaauucaggguaucccuugguauuaauuguuccuguuagugcuaguucuuguauaaacuugauguaagauuuaguacuaguuacagauugaagcaucauccuuauagucuaacaaauaauauuaacucauuaacagauaacuaacaaauaauauuuauuugaacauuuauuuuuuuugggggggaauggauugucgaaaucugaaaagccuuaagacugagcuaaauacacauuuaauaaaaaauuuaugcaccuguccuaccugauuuuuuuuuuauuaucuucuuauacuauuuuuuucuauaauaaaguuauugaguuaagaaccaguuaaaacuuggauaguauuuguaaaauuucauuuaggacgaaauuagccccuucuguaguuggaguaaaauuaacaguugagucuuguaauuaugcuaacaaacuguugcuaguaaaucuuauuuaugugaacuagucauaugguuugacaugauucauuugauaauauccauauucgacuaguaguauuuuauagaagcccuggccuucaucaauucuguguguuugucucauugauaagcaguagaauuacaaagauagguacuuuuugagaaaauuccuaagaguuucacccagcucuucuuuguccuauauugcuuucuuuuccacuucuccucuuuuuuucucuuucuggaucauuuucaacugaaccccucuaaaauuucuugguuuuucagcauacuagugggaaaggguuagaaauagaagcaaagacucagacuuuagagaucaaauugaugacccugagcaaaggauaauuauuauauucauauuagauuaauagcaaaaagguggagguuuacagcaagcuguauucaaaagaauacccacauaugaacugauggaauucuacucucuuuccacgucuuuauucuccacaaaucccuauuguuuugaaaccuuguucuuucuuucauaaaaaaacuuggcagaauauucauguuaaucacaaucuuuuaugacccggucauuuugaacugcauaguaagguuguauagagaaggaaugagaaguuuugcagugaacucaacauuaauaaauauaaagaaagaaagaaagaaagaaagaaagaaagagagagagagagagagagagagagagagagagagaaagaaagaaagguuauagaacccuaaccuugagcuaugaaggaaauaauaccguuuucuccuuaguuuauaagugaggccuagaaaagauuacauaugugacuuuuguaaguuuucuauugaaucucacauuucaguguuaauuagauuagcuggcuuaaugguagacaguaggcgaguaaauuagaauuaauuuuguuuguuuguuuguuuuuguuuuuuguuuuucgagacaggguuucucuguguagcccuggcuguccuggaaaucacuuuuuauuuuuauuuaauaaagaauguuuagccuauccuuggacuucugaucuuguuuaucuuuuccacuugagugcuaaaauuauguguguauaacacuccuagccaauucuuuuuuguaagcaaaaguuuauucauuauuuucaaucaguauaacaacucuuucccccaacuguuauuuuuagaagaucugucucacaagagaauagucaguauaaaaguauaagguacuauuuuuuaaaauuuguauguacuaagcaauaaauaaauaauaaagaaauaaaucuacaaauucuacuaaaaaggaaaaaacuccaauauuucuuuugcuuuauuuugaaugguuuuggccuuuuuuuuuuaacgagaaaauuauacagauauaaauacuaaugagaucccagcuuccauuugaacaacaauccuaguguagaaguuuuaacagucuuaaaaaaaaaaaaaaacaaauaaaacaaaaaaaaaaaaacaaaaaacagauauucuuuguaggcuguuguguugguuuauuggguaaagucacuugccaccaggcuugaugacugaguuuaauccacaagacguaauuaacuccuuggcacauguuuucuucuaccaccagcaaauaaauggcacauuuuucuccucuuuuuaaaaaauaaagugauuucaaggauauagcauauauaaaaucuuaaaaccuuuuuuuaaaaaguggaauaagaucagauguauccagagacaguauugccaugugcgagaugcuuuagacugcguucacaaucuaaaagcagaauugcccagaaaauaaaaacacagcaacagaauuuaaggucuggacuuuuaggaguucagacuaagaauucugauaggaaaaaaaaaaaaaaagaauucugauaugaaaauguaguggucuguucuuuacauguuuugguacaucuaugcuacaaaucaauauuugggaaacaacaguuaguacaguuuauaaguauaaauuauugaauaauauccauguguagaauauugccaguguuuaaaacgaauaaugaagucagugugacuaaaauaggaguugacagugguaugggacaugaauaaauuuaguuaaguucuagaauuuuccauaguuaaccaaaaauaauugcuaaguuguagaauuggaaagaaaaguccaaaaacccaggagcuggcacacaucgaugaagaaaaaguuguuugaauuacuuccucaauuucucugaaagucuagaugcauugucuagcugagcuuccaucauuucucuuaguauaaauaccuauugcaacaagaacuugauuuaaaaaaaucauuugacauacauugcuuuaauaauggaguuuuucugugcugcucuagguguaauucauucauuaauagaauuguacuuaaugugauuucucuuauuuaaaauuauucuaauagaaauuaauggaagccgggcgugguggcgcaagccuuuaaucccagcacucgggaggcagaggcaggcagauuucugaguucgaggccagcuacagagugaguuucaggauagccugggcuacacagagaaacccugucucguguaaaaaaaaaaaaaaaaaaaaaaaaaaaaaaaaaaaagaagaagaagaaagaaagaaagaaaaaaaaaagaaauuaauggaauccucuucccuuuaucuucaaaauaauuucuuacaaccagaaugggagaugaaguagucaguacgauaagagcuuagcaucauauaauaauuuaaaagaaagaaauuuagagagauuuuuacuuauagaaaugaaagucauauuuagauuuuuaucaaaguguauaaauuacucuucuuggagagucuaaacauuuuuaaauagagcuaauuugaguguuguucaacuuaaauaguaucauuaguaguuuuuuguuuucaguuauguuaacauaggauuuuagaugguaacucuggaugucuaaagguuuuauuuagccugccugccugccugccugccugccugccugcccgccuucuuuccuuguuuccuuccuuucauguuuauuuauuuucagacacaucagaagggagcaucagauccuauuacagauagcuuugagccaccaaguguuugcuuggaauugaacuuaggacuugaaagagcagucagugcucuuaacugcugauacaucaucccuccagcccugucuaaagguuuuaaaugauggcgcuaaauuuuuuuuugauccuugaagauaugguuauagaauguuuuuuuuuuuuuuuaaaucaguauaucauucugcuuagauuucuuggaaugcucuccuauaaggucagcuuguaaaaaaugaucucucuaggauuuuguauugccaaauaaauuaagaauaauauuuuaacaguugaugagagugagauuuccuaguaugaagagaaguacaguuaggaagugauaguuacuauuguacauuaauacagcauaguaauaccaguguauuuuuucuccagcgcuaucuaugaagccaauacuaccuauuuugucuuauauuuuuuucagaauuuuaaguauaucccaauaguuuucauguauccaauuacauguaagacagcuugauuuuacaaauucauuuuuaaaauauaacuuuaauuuuuuuuuuuauacuauucuuuaguugaugaaacaaugguuuaagggugugugugugucucuucuaagaguuacauuuuugggcggguuguauuuugagaggguuuauguagcccuggcuguccuggaacuugcucgcucuguugacuagucuggucuagaucucagagauccaccugccucugccucuugagugcugaguuuaaaggcuugugcuaccaccucucagcaagaguuacuauauuuaaggaaaaaaaaauaaugugacuuucuuugcuaauggcuuuuguguaugguuaguauuaaauuuuauguuuuguuuuguuaccauaguuuuuaaaaagacaggcuacugaugcaucaucucaaacaaaauaagaauuuacaaagucacuuuggcaacauugagaauggucuucuuaaauugcuaguuggacauuuucacuuacagaauuaagcugccaacuauuuuuaaauuauauacaaauauauccugauucugaaaauaauaugugaauauaguugaaaauauugauauccaaagaagucacacaaaaucuaaaagcaaauauuaucucuauuuucuuuggaaaaguagguaaacugugggcuauaagcuugcucccuggauuaaaacuucucuucugaauuacuauuucuuaaguuauuuauccuuuuauuacuucaagggacuuucuguaaaaugguuuuagcagccuacuugcuaaggaguuguagauaucagaacaauuuuaauuguaaagugagcuguaaguuucauaauuuguugcugcugcugcucuuauuccgggaauacuucuguuuuuaaaaucaugugguuaaauauucuagcaaaacuggaaauacuuauuuacuuguuaucauauuuuagauagagaaucacuauaaagcucucacuggacucagauuuucuguguagacauaacugcacuaaacuuaccgaguuugagugcugggaugaaaugcuuguucuaucauauauagaaaacauggaauauuuaaaaauuacuagaaugacaauacuugcaacuucaaacuuagaguuaaugguagagcauuaauuuacacacuucacuuauuuauuugauacuaucucauuaugcuuauuuuacauuucaaacgaaagcaaaaauauagaaaauuauuuuuagugaucauaauagaacauacuagaaccagaauugggggaaaaggguagagacuggacagauguaugcugucuugaaaccaacaagccuuugaaucaauaauuaacauguuuucuuagcaaguugagaacugggagaaaccacaguaauaauaguauauuguguugggaccaaauuugagcuaagaugaucauggaaauuuaaguguacaaaguuauucugucuuagaacagguuucuagcuaaugcuguuguugguauaauuuuguucuccauuucuaagguuaaauucaaaucuauauauuuggcuguaaagugucagaccuaccuauuaauuucuuggggacauaaauuuaugaauuuuaaaagucuauaguuuugaaggguaauauguuaacaguuuugcuccuuagaaaugauauauuaagcauauaccauuagaguaggaagaauauuaccucuguuucuguaauacauuagaaaauaggauugauuuauugaagcuuaguaauuaaauguuaauauuuaguggugauauguggaacuugugaaagaacaguuucuuauauguucaccaacaaaguacugcugaaaauaaauuucaaugaauacugaccugaaaauuggguaugcgagcugagaagguagaucaacuugcaagaagaacugaguuuaaucuucagaacucuauuaaagaaaagaaacuugaagugggcauuguaguccugaugcuagguaggcagguacuggcagagaugccaggggccauugacaguccaaccuauuguguuaugcagucuuccaggucaaggagagauccuuuccugacaaacaagguggacagauccugaggaaauacaucuuagguggaaggagacaugugaauauacauacaugaagacauacaaauuaguuaaaguagaccaauauagagauucuuuacagaauaaauucauaggcccuuagaccccuaaagaugaagauauacaggacauaauugcaacuauuccccccaccccacccccaacagcauuuuggcuauauccuuuacuaagaaaugcauagcuucuuaaacacaguacauacucuuguguguugaaauaaaucuugccaaaaacuguaagucaguuugcuuuuuuucuuuucagaaacaaaauucauuguuuucuuuccauauuguuuuguuauugcugcuucuuauuuucuucuacuuauaucuuacauuuuuccucuucucaacuguccucuuuuuuauauuuucaaucaacagcuagagaugauugcuauggaaaauccugcagacuugaagaagcaguuguauguggaauuugaaggagaacaaggaguagaugagggaggcguuuccaaagaguuuuuucaguugguuguggaggaaauuuuuaauccagauauugguaaguauuagugauaugauuaugaugguguguuagucuuuuaaaguauaaacuugguuuauaaauauuuucaguuaugguaagcaguaaaaaaauugaguaugccauaucccugcuucaggagcuguucuaucacucacuuaauuuagguucuuccauauauuacuuagucaaauauucuaguagaacacaguugccuucuagggaaauuuaauuugaaaaaccuuagagugguagauuugaaaaccugaagucaugagaaucauagguuauauaauuuauccucugguuaauuuauagcuuaauuguccuugagaccaagagcauccauuggugacauucuaucagauuuauuauuugugaacuggaacuuuugauauuaccuggauguauaaccuggcaugcaaaugauacagacauacauaacucacauuuuucaagcuggaaugcaaguaugaauugaauacuugugaaaccaguauuccacaaauauuaaauugcaagaaaaagcuuagacuuaauuuauauuacuacaguucaaggagaaaaguguacuuuucuuuuuaauuaaaacugaaagugaaaauaaggaaacauuuuaaauauuaaaauuaaccugaaaguacauuuuaaugcuuuauuauuuguuuuuuaauacucuuguuccauuagaaaaacauuucccaaaacuuuuugauuugcucauuuugauuuuggcuuuuuuagacaaucuuuuuauauuguauuaguacucuaaccuuaagcucauaauuuuccuuacucauuuuaccaagugcuaagguauacagcccacucucucccccagcuuguuagacuuuguauaaaaaguauuuccugagaagcaacugaaaauaaacuuagaaaaauugaaaggcauauacaauuaguuuuguuuuauuuuauuguuugauguuccguaaaaaaagaaaaaaaagacuaucucuuaauguucaccuagauaaaauaaugaugauaggaaaaaaaaucucuggacuuuggcuuugaauaaugaagaucaugugaagcugaaagaucacaaaauauuuuuuaaaauuauauuagcuuagauuugauaugaauuuuaaguaacuuaaaguuaaucaacuuucuccaauuguuuuuuuuuuuuuuacuuaaucaugcauuuguuucauauguaauuuucagucauuaaguggauaaaaugacuuuuaauuauuucuuuauagguauguucacauaugaugaagcuacgaaauuauuuugguuuaauccaucuucuuuugaaacugagggucaguuuacucugauuggcauaguccugggucuggcuauuuacaauaauuguauacuggauguccauuuucccaugguuguauacaggaagcuaauggggaaaaaaggaaccuuucgugacuugggagacucucacccaguaaguuguccuucguuaauagucuuuaagauuguaucuaaauacagaaguuuaucucaguuuauauaggaacauuauuuauuuguaaacuuuuguugauacugcuguuuaguaaaguaaaauacuuuuaaucugguuaaguauaauaaacaucauuuuuuauauauccuaucaaguauguuuugauugaccccauaaaaaauguugaaaacaucauguuuucaaugucccauaugagucuauguaguaaaguuguugauagguacaguugauauguguguggcuuuuuuguuguuuguuuuccuguuuguuuguuuguuuguuuguuuguuuuuccucauuuccuguacccugccacaaucauggagagaaaguguauauucuagaccaugguaugaaaucuguugcugaacugaucauuugaagaauuuuuaagauugacccauugccugugacaaccuuucuaucuuauuaaacuacuugagagauguggaauauuuauggcuucauuuuuguugacaaguuguuucuacaaagaaugaacaaucuauuauuuuuauuucuuuuaguauuuauuuggcaaccucacuucucuuucugguuguuagguuuuauaucagaguuuaaaggauuuauuggaauaugaagggaguguggaagaugauaugaugaucacuuuccagauaucacagacagaucuuuuugguaacccaaugauguaugaucuaaaagaaaauggugauaaaauuccaauuacaaaugaaaacaggaagguaauuaaauuuuugucauuguuuuauaaauauauaauuucaaagcaguaaaguuuucaaagaauuaccuaguaugguuugaagcaguuauaaaaacuuuacauaaacaaauuuaucuaaauaguaaagcuacacuuuccucuuagauaagagcuuaugugauuguacagaauuguuaauuccccuuuagagaaagacuaaacagacuacaaaagauugaauggguaaauauuacuauaauguaacgcuagaaacagggccuuaccauauuaaaccuaagagguauacagagcccagugauugacaucugguuuaguguguauauacauuuuccauuugagaucuaauuaugcauaucagauuauucacauuagauuugguuuuuacuaacuuuaaaagcuauuuacuuggcaauaggaaauaacuuagcuuaaaaagaaaauauuacauaguauaauuuuaagaaauauauuaauuuauacuuauuuuuggugaaauauuguacugucaugagaucuaauuaugcauaucagauuauucacauuagauuugguuuuuacuaacuuuaaaagcuauuuacuuggcaauaggaaauaacuuagcuucaaaagaaaauauuacauaguauaauuuuaagauauauuaauuuauacuauuauuuuuggugaaauauuguacugucaugauacaaacuacauuuguacuauaacaaauuuuauaauuuguaaaguuuucaaagaauuaccuaguaugguuugaaguaguuauaaaaacuauaaaauuuuauaauuuguuauaauagcuuaguuuaccaacaaauaacauuuuugcugagcuggauacaguagcuaacuuaccaguaccauaauuuccagaggaaaccugagacauucugguuuucucaaguucaguauucauaacaaauuuauauugcauacuagagguucuguuguuauauauauauacagucuuuuuaaaucuuuuauuuuaaucuuacuguuuacauuauuucauuauuauuacuauuaauuacauuuuauauaauuucucuuugauuuacucauagaaucauaauguauaacuaugcauaugaauacaacuuuuauaucugucagaagugagaaauugugaaaauaauuuucuuuguacauauaacaugugauuaauuuuuuaagacuuauguuuauucuucaagaguugcuaaugcuuuuuuaagcacugaaccaacucucugaaaucuaauuuuuaaacauaguaacaaaaaaaauacugcugaagguuuucuugggguggaggguggguauuaaaacuaguccaaaagcuaauuguguuucauuuguauagaauaugcuuucuuguuaauauuccuacaggaauuugucaaucucuauucagacuacauucucaauaaaucuguagaaaaacaauucaaggcauuucgcagagguuuucauauggugacuaaugaaucgcccuuaaaauacuuauucagaccagaagaaauugaauugcuuauauguggaagccggguaagaaagacauauacaaaaaaggucuuuuuuuuguuuguuuguuuuuguuuguuuuuuuuuuuguuuuggguguuuuguuuuguuuuuuguuuugguguacuauggauguuaaggugcuuuuuuuucccccuauaauuuucagaaucuagauuuccaggcacuagaagaaacuacagaguaugacgguggcuauacgagggaaucuguugugauuagguaagguguuuaauucuuaaaaaggaagauuuuauucaucaaacauguagaugugugcuuuuguguccuguaucuguagguacugguuaccaaacaaguaagcucaaaaauagaccuguauuaauauuuccaauuuucaugcagucuaaugcuuuauuucaugaauuaaaugauuuaagucucauauuuucucaacccuuugccuuauuuuuggucauguguaagauggcacauuauuuagucuuuaagauacuugggaagaaccauguauacuagugauucugaacaauucuuaggacaguauuaccacuaacaucguucucuagucaaaugcccuuauuucuacuucuguaauaugcuacuauccaauucugaaagaucuuuccccccaucuucuaaugugacugaucaaaaugcagaguagucuuuuuggcauccacuaugaugucauagguauuuaaacaguuaucuuuuuguagaucacuugagcuauaagacucaaauauguuaacaauagaaugaauauuaacugugucuaguaaugauacauuaucauuguuauauuuauauuacaguauuacuuuauucauuuaaguuuguagaagauuacucuugcuuugcccuuuuuuuuuuaauagaaaagcaaauauguuauuuauucagcuuuuagguaauuaaauaacaaaauucagaguaaagcaaaacaaaaaccauaacaugucauaugauauaucauuucuaagcacaauggcaauuauuaaugaauauaaaaauuuaucauucauauuugcuucuaacaccagucacaaaaguggcaaccauuauauugcugcucaguuuuaaagguaauucauaacagggauaaacaugguaauacagaagccuuaaugggaauauccuaguauuaucucuacaauauggcaaaauaauguuuuagauugauuaugauuaauguaugcauuuugauuauuauccuuuuguuauuggcaauagaauuaucaugacaguggggcuguuacaaauaaaguuuucauucuuaguguugaaguguuuucauuucuccugaagaagcacuuuggaggauugugguugugaaguaaauaacauuuuuaaccuuaagaagcacugcaagaaugcuuuuguaaaaugauacugccauuuuaccuaagaugacaagcagugcuagaacguauucuguaucucuuuuaaucuuuggucauguugucuuggagugugaaauaaaauuuuaccuuaguauaaauuugcuuaucacugaugacucaggaucaugagcugucuuuuagguauuuaucuuuuuuuaaaauauuuuuauuacauauuuucuucaauuacauuuccaaugcuaucccaaaagucccccauacccucccccccucaacuucccuacccacccauucucauuuuuuuggcccuggcguuccccuguacuggggcauauacaguuugcguguccaaugggccucucuuugcagugauggccgacuaggccaucuuuugauacauaugcagcuagagacaagaacuccgggguacugguuaguucauaauguuguuccaccuauaggguugcagaucccuuuagcuccuuggguacuuucucuagcuccuccauugggagcccugugauccauccaauagcugacugugagcauccacuucuguguuugcuaagccccagcauagucucacaagagacagcuacaucuggguccuuucagcaaaaucuugcuaguguaugcaguggugucagcguuuggaagcugauuaugggguggauccccagauauggcaaucacuagaugguccauccuuuuaaccauuacuuugugaauuaucuuccccacucuucuuuccacugauuaugaacuauuucuuuuggaauguauucuuuuuaaaggaucauaugcaaacauguuauacauguguuauucuagucugcagcuuucuuucccccacugaauuuuauuuuuguugaaauugaguuuugugugaguuacuucuagacuugguucuucucugcuuauucauuuguucuuugaucaaaaucacaucuugaugacuccuuuaccuugauagaacaaagagcaagucuuuauaucagauggugagaaucccuuuacuuuuucauuguucuuaauguuuucacuaauuuuacuuccauguaaauauuaaaaucuguuugcugaauuuuacaugaauaacauuuauuuuugauguuuugauuuggguugaauugauuggauaaaucaauuugagaauugucauuuucaucacuuuggauuuucuaaaucucaagcauggcauagcacuuuccauuuaguuauaccauaguuucauccagcauugauuuguaauuuuuguguugaaauaauguaugcuuuagugaauaaguuuaaauaauauguuucuuaugcauuauuucauuguucauuucugagaauaagcuuauaauuacuuucauugcuuuaaaagccuugucaguaaaauucaaacaauuuuuuaauuucuguuggcaugaguuguuuuaauuucuuuguucuuggcaugauaguuuccguuuuauuuuuugagggcuuucuuaaaaauggauuguuuuuccauauaauauauuuauuguuuucccuguccuccuaccccuuccagauugccuacaccuccccucccaucugcucccugccuuuucugacucuuauaaggaagcaaacaagcaucaaggaauaauaaagauaaacaaacaacaaacaaauuaggauaacgcaacagccaagcaagaaaaagaaccaaagagaaaaauuucuagaugauucuauagauguagagacacacauauuuguguacuagagaaucucauaaaaaaugcaaaacucacaaaacuagaagcucuaauacauaaucagaggaccuuuaagauaugggggggagaaacaccaugaauuaacauuaugagaccaagaaccucugcagaugccauuguguuggucaacuaacuguuggauaugggccccacacauaagaauggcauguuucuccagugagacucacucucucucucucucucucucucucucucucucucucucucucucucucucccccucccucccucccucccucccucccucccuccuuccugucuuugaguagaggaaaacuauuccucagcuauuugcauguuggcgaauauauacuucauguagcuucuugccagcuucuuuuugcugguacuucuaacaguaccucagccuaugugguuaucuuugucuuaccuagggucucuaagacucaaaggauaggagagcacuucagggcaacaacuauuccuagcagaacuuugcccauagcccauuaauacuguauauuugaaccauggugcaacuuaauugcuuuuugaaucuucauaguuuuaaucuuucuauuuuagguuuguaaaagauuguaaaauugucuauauuccuaguuguguauaguuuugaauuuaucucuaguuucuuuguauuuguuauaauuuuuaaaauuuauuucuaauugaaccuuauuucugucacauuuuuucaagguuccucucuguuaagguuuucuaaacuucauuucugaucuaguuauuguuuucauagccuuuauuuuagaauuuuaguuuuuacuauguauuucuaauuuucuugucuuuauaguuuucaucuuuuguugauauugacaaaguuuucaugauuauacuauuuaauaaaauuguguguuuuauuuugauuccuauuuuuguuucuuauuuuuuaaaauaacauuacuauauguuuauacuguaaaauaaaauucuuucaguuaauuaaaauacgaaacaacucaacaauagaaaauagguaauuaaauacuuuuaaaaauaacaauucuuugguuuuugauuugauuuuauuuuuuuuuuguaugaguggccugcauacuugagucuaugcaauguguguaugcaguguucacugaggcuagaggauggaguuggauucccugacacuggaauugagccaucauauagggguugugaauccagccuggauccucugcaauaguagcuggugcuuuuagccaccgaauaaguuccagcccuacuucuaaaauuuuaaaugaaaaguugugucaguuuugccuaugucuaauucucuuagaucuugaggccuuauuauguugaaaaucuuggcuucuacaugcaguacagauacaguuuuuuuuauaauguauccaucagggucauaucauauauuuguaaguauuauauauuauacguguuuuuaaaaauaaaaucuuuccuuggcuuuuuuuguuuuguuguuguucuuauccaugcuucuuucccaugaaaagaaugauagaccacuucaucacuauaucuucuucagaaagacuuugaaacuauaacaaucaaaauuacauaguacuacuauuaaaaaucggccauucaaagggaacaguuccaaauacauuguauuuuauguuagaauaauuuuugauguaaaagcucaaguaauuauucauucaaaauauauauauuucaauugcuauaaacguggaaaauccacagucuauuuuagguuuugacaagagaaauaaauuuugcauccuugacaaacaaaacuucuacgcaacauagugauuaucauuuucauuuguagaagaauguucuuuaguuccucuucuauaaagaggaaauaagccaacauaagaaaacagaacaaaacaaagcaaaaaaagaaguguuaccucuggucccccccccccuuuuuuuuugccacuuuacagaauagaugucuauacuaagaaacuuuaaguaacagggagaaaggaaagaagaccugcugcugugugcuacaaaagagaaaaaugauuuguuccaugccugggagaaaacauguuaauagauuaaaagaucagggaucaauuaguucuuacuuucuauaguaaaaauugagcuauuaaccaacuagguaacauuuguuuuuguuugguuuacacacacacaccuuccuccauuuucugguaaauuccaauaagcuucuuucaaucuccuccaaauucuccuccccgcauuauuucucccaccaaucaccuuguaauuucgggcuucaaaucuccuguuacuuuaaaucuaaguggggcacuugaauaguugguggauauuuuuauaauggcuuguugaacuacuuagcuccugguuugguuugcucuucaucuuucauaggguaguaauucauaaugcuacugcccuucuuucuccucaucuuuuguagugcuacuucaguucuuuuuuaguucaaguuaaguuuauuggaaauaacucuuguucuucaguucuuugugccauauccccuuuuuaacuauucauucaaauagguuuucauguucacuuuuaucaguaaauggagccuaauuuuucuuuuccuggcaugcucuggaaccauugcuauaugaaaguuuuccgcuuuuuuuuuuguuuuuguuuuguuuguuuuuuguuuuuguuucaaggucuauuagcuguccuuuuugcuguucuuuuuugcauuucuuuuucaacgaacuguuguuuuuuuuuucuuucaaaaaauuuuuuuaauuaucagugugaauaaaaucaccauuauuuaaugugauuaauucuucauauucucuguucaauucaaagguuuucauuuucuuucuuuuuuacuauuuuuugucuuaguuuuuguccuagcuucuuuauuuuuuuuuuuuuuccauuuuuuauuagguauuuagcucauuuacauuuccaaugcuuuaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucaguaaaaucuugcuaguguaugcaauggugucagcauuuggaagcugauuaugggguggaucccuggauauggcagucucuacaugguccauccuuucaucucagcuccauacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauuugguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacaguacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcuagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagacagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaagaauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauugucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuaggauaaaauguucuguagauaucugucagauccauuuguuucaucacuucuguuaguuucagugugucccuguuuaguuucuguuuccaugaucuguccauuggugaaagugguguguugaagucucccacuauuauugugugaggugcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaacgcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccaauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucccuagcuucuuuaaaaguacacauugcuuuaaaugucauguuucuucuuaaccuugagucaauauuccuguccuuguugcaaugguucuucaguccguguauuauauucuuuuguuuguuuguuuguuuguugcuuuucaagacaggguuucucuguguaucccuggcugugcuggguagaccaggcuggccucgaacucagaaaucugccugcaucugccucccaagugcugggauuaaaggcgugcaccaccacgccuggcucguguauuauauucuuaauuugcucagguccaauuuucuuuucuuucuuucuuuuuuuuuuuuuuuuuuuuuuguaaaagcacauucugcucauuucuacauggucauuccuccucgguucuuuugaguuuuuuucugauuuucuuucuccauuuuagucaccuucaagacugaaucuuuuuguucuuagaagagucucuugcuuauuaugaggagaaacauuucuuuugugaaauauucauacuuucucuaugucauuugaggcuuuguacauuuuuauguucucuucagacacaucagaagagggcaucacauuccuuuacaugguggcucaugguugugugauuugugggauuugaacucaggaccuuuggaaguguagucagugcucuuaaucgcugagccaucucuccagcccggcuuuguacauuuuuauacccauccaguucauaauccauccaucauuaaggaaacuuggagcaggauccauugcagcacugcuugcugauuuauguuccucuaacucccuccucauuuuuuuaaaaagagaaauaauucugucuccuuuucagaagacuaaaauaaacaaaacauaauuguugaccucucauuuuccuaucuaaauuugcucuguuuacagagauuguggagcaguaacaaaauugcugugaucaauaguccuuugccuuguauaucuuuuuugucuuuccuuaauugaugauuucaccugugauuauaaaaauggugauuuaaggaaauaauuuuaucuagucaucugacauaugucauucuccuauuuuccuaucuuuuucauaucaacuauuauauuguuaccuuaagauaucaaucuauugaaaagacaaagucaaauauauuuaagauugauacugaagagauaauaugguaauuuuuuuguuuucagauauuaugaacucaugaauuuacuuuuaauguaguaaauguguuuuaccauuaggacuuuagccuugcuuaggacuuugcuugguguugguguaucuuuaacaugacacaugacuuuguuaaaauuugaaauuuugccuuaucuugaacauuauccccuacccuguaagaaaacauuguuaaaagaaauuauuagaaaacugcauccaggaauaagacuuacuauuuaauguuaugacugguaaggccuugucaaggaacaaaccuagaaagaaucuuuuaaguauauuaucaaaauaaucccuuauuaacauagagguuacuuugcaacuuuuuugcucucuuccagcugucacauaauauugaaguauaguuuucuauuuucaaggucauuauauuaccuaaucauauuuuuaauauugucucuuacucauuuuauuguucaguuauugaucccccucacacccuucuuuugaacaauagcuugcuuguagcauagccuagccuagaacuugccuaccuuuugccucaaccuucaaaaugcugaaucauaggaauacuuuuuagauuuccuuucccuuugccuuuucuuguacaugagagacauuugucucuggaguaauuuacaguauuuucucuacauuaaugucauuuaucuuuacuuguuaggguuuuuuaccaagugaaagguuuuagucaauuaacaauuuguuuccauuuuacuuugauaugcauuucuucaguuuugaauauuuuguuuuaacuccuuuccccuucugacuuccuaacccuuugcuugcuuuuuguuucuagacuguugucaaguagaaauguuggauguuugucaaauacaaauuacuacacuucccucauuuacuuaccucauuuuugaaucaucuuuuauuucuagaguugaugugcauuugccucagaauuuucuuuuuucuuuuuaagaauuauuuauuuauuuuauguauauggguacacuguagcugaacagaugguugugagccuucgcaugguuguugggaauugaaguuuuaggaccucugcucgcuccggucacucugcuuacucuggcccaaaagauuuauuuauuauaauacauaaguacacuguagcugucuucagacucgccagaagagggaucaucucauuacggaugguugugagccaccaugagguugcugggacuuugaacucaggaccuucagaagagcagucugugcuccuaccugcugagccaucucaccaaccugccucaguauuuucaaguguuauuauuucuguuugaauucauuaaucucuuuauuuuugauucaugaugccaucguuaaacuuuucauguuagaguuuauauuauucacgacucagucuuuuuuaaaaauaguuucauauuccaaaaagccuuauuucucauuugaagaacucuucauaauauuccuauuggacuuaaauuuauuuuuuaucauuuacuuuuuuauauauuuccucccauggaccugcucuuaguaaaugucaugggguagcaaagcauaguacagucacuuuaagugguuucucaaugaaggaaaaccuuuuacugcuguuucuuuaauauuugguucugcuuuaugugauucaaugccuucuacuuuucacuuacaauuuuuuaaaaauuaaaaucccuucaccagguauuucuaucaucuuuggaaaguuucgucacuucuuucuuccgcucuuccagugucuacaauuuuuuuguccuauucugauccuuaacugugcuuaucuuguguauuauuucucucuacuuuuacuuuggggauuuauuacuugauuuuccaauuuuauucucagcauagauuacagauauauuuauugcacauuucucuugcuuuggagaagaucuugauagauuuuuagauugagguuuuagaaaugugaauaggauauugaacauguauuuuuuacaaaaguaaauuuuaaaacaucacgcuuagcauuaggaauacaaaaguacuuuuuaaguagaauuacugagcaaaagaguuauuaauauuuaucccauauauaguuccuacaagauauaaaaucuggcugacuaaaacuuacauacuaaguguaaaugguacuuuuaauauucacugugacauuggccuuaauguuguaguacuaugaucuuguuuauaguggaugucaaauuaaaaccaguauucucuuuucacauuagggaguucugggaaauuguucauucguuuacagaugaacagaaaagacucuuucugcaguuuacaacaggcacagacagagcaccuguuggaggacuaggaaaauugaagaugauuauagccaaaaauggcccagacacagaaagguaauaucaaacuccaacuuuguacccacuguaaaccuuuucaccauauuccauacacgcaagcagagccaacauguagccucuauauacucuucugauguuauauugaaauaucuaagucagcaaacacuaguggaauggauauuuucccuucaugauuugaggaauuuuuuuaaaaauuaguguaguuaaaaaguaauuauggagcuuacagaaguacagacguuaucaaguuguuauguuuuauucccccuuuguuucauaguuuauuaagaaagccuuauuauagaacagucuacuuugaauggcuacacuaaaauuuagaggauugucuguucuuuuacauuauacuagauucuuauucuaggguuaaaucauucugacuuuugauuguauucuuucuccaauaaauacuucacaauuuuaugguggggcugaacaauauguccuagguagacuucgauauacaucgacagauauauuuuuauuacuguuaauuagacauuuuauacaucuuggcucuaauuuuaauuaauuuauaaucaaucauuaucauuuucauuuugccagcaguauuucaaaucuauauacagagcauagacuucaaaaucuuuaaaagccagguuugaauaauuuuuaaucuuugguguaaguuguuuagugacuucagcuuuuaauggguuuaguaagauguuuguuguguaaagauuuaaaugaacuucaguguuaaaguaucuaaagcaauagguaacagaguggaaacucaauagauaauaaauguuacuaucaucagcaucacuuuaauuuuugcauuauuucauaggauaaagacccaacugaucuuuuuaacuaaacaguacaauguuuaugauauauuuaaucuguaguuucucauuaaaaaccguccuaacaagauauguaucuaauaggagcauuuaacacugagcauauuuccaaugacucaugauuguccuguuuuucccuuucucuuuauuuagguuaccuacaucucauacuugcuuuaauguccuuuuacuuccggaauauucaagcaaagaaaaacuuaaagagagauuguugaaggccaucacauaugccaaaggauuuggcaugcuguaaacaaaaagaaaaagaaaaagaaaaagaaaaaguuaaaaaauaaauauaagagggauaauuugaugguaauaguaucccaguacaaaaaggcuguaagauagugaaccacaguagucaucuaugucugugccucccuucuucauuggggacauugugggcuggaacagcagauuucagcugcauauaugaacaaauccuuuauuauuauuauaauuauuuuuuugcgugaaaguguuacauauucuuucacuuguauguacagagagguuuucugaauauuuauuuuaaggguuaaaucacuuuugcuuguguuuauuacugcuugagguugagccuuuuugaguauuuaagauauauauaccaacgaaacuauucucgcaaggaaaacauugccaccauuuguagaacauguaaucuucaaguaugugcuauuuuuugucccuguaucuaagucaaaucaggaacuuuuuucuaacaauuugcuuuugaaacuugaagucaaggaaacaguguggugcaaguacugcuguucuagcccccaaagaguuuucuguacaaaauuuugagaaccaauaaagauggaagggagaacuuggaauguuugaaccacagcccucagaacuuuaguaacagcacaacaaauuaaaacaacucaugccacaguauguugucuucaugugucuugcaaugaacuguuucaguagccaauccucuuaguauaugaaaggacagggauuuuuuuuuuguuuuuguuguuguuguuguuguuguuguuuuuguuguuguuguuguuuuuguuguuuaaguuuacuggggaaagugcaucuggccaaaugauaggauagucaagccuauugcaacaaaauuaggaaguuuguuguauaaauaagcauguaaaagugcacuuaaaaugaaucuuuauuauugcugagauuuuaauagacaauccaaagucuccccuucuguugccgucaucuuguuuaaucaaccauuuuucaaggcacucgaucaguguugcagcauaacagaaaguacagcuacugugccuuguguuacuuauuuacacaguuagcaggccuggaaaugaauggaacuaguacuccugagaaauaaauuguauaucccccaaauuaaaauuuacuucaaagguguuaaagauuucauguccuauauuaaaguacaaauaggcuuaaauuacuggauauuuaauguaguuucccaucccuagucuucuaugucugugauguuaauuucuuuuguugcauaacaaaauaaaagaauuauguauuuuuaacuaaggagagacauacugguauaucauuuuacuacaagcuacagauaaccuguugagcuugugccuugauuguuuuaacaacuagugcaaaucaaccugaugauuuuaauuggcaggggauaaugguagcuuucaaaucauuggaaggggaaaaggaugucuuaggauuauuuucuuucuuguaguaguugagacagagcucuuauuuacuguaaugcuaaaugaaacaguggcuuaaauauuuuaaugggaaaagagaacacagugcguuccauauugugauaagguaacgugagguuuuuuuguuuuguuuuguuuucuuuuuuuuuuuucugagcuagccuuuagaacacuguugugguauguaugcuaccuugauuauaggacccccuaaaugugacuauagucaucuuaaugggcaucuuguccacugugcuucuuauguauuaugaaagugauaagaagacaaauuaaguggguauauuuuauaaaauaaauucaug

SEQ ID NO: 12128 - RNA, 77979 nt, Mus musculus
caugaauuuauuuuauaaaauauacccacuuaauuugucuucuuaucacuuucauaauacauaagaagcacaguggacaagaugcccauuaagaugacuauagucacauuuaggggguccuauaaucaagguagcauacauaccacaacaguguucuaaaggcuagcucagaaaaaaaaaaaagaaaacaaaacaaaacaaaaaaaccucacguuaccuuaucacaauauggaacgcacuguguucucuuuucccauuaaaauauuuaagccacuguuucauuuagcauuacaguaaauaagagcucugucucaacuacuacaagaaagaaaauaauccuaagacauccuuuuccccuuccaaugauuugaaagcuaccauuauccccugccaauuaaaaucaucagguugauuugcacuaguuguuaaaacaaucaaggcacaagcucaacagguuaucuguagcuuguaguaaaaugauauaccaguaugucucuccuuaguuaaaaauacauaauucuuuuauuuuguuaugcaacaaaagaaauuaacaucacagacauagaagacuagggaugggaaacuacauuaaauauccaguaauuuaagccuauuuguacuuuaauauaggacaugaaaucuuuaacaccuuugaaguaaauuuuaauuugggggauauacaauuuauuucucaggaguacuaguuccauucauuuccaggccugcuaacuguguaaauaaguaacacaaggcacaguagcuguacuuucuguuaugcugcaacacugaucgagugccuugaaaaaugguugauuaaacaagaugacggcaacagaaggggagacuuuggauugucuauuaaaaucucagcaauaauaaagauucauuuuaagugcacuuuuacaugcuuauuuauacaacaaacuuccuaauuuuguugcaauaggcuugacuauccuaucauuuggccagaugcacuuuccccaguaaacuuaaacaacaaaaacaacaacaacaacaaaaacaacaacaacaacaacaacaacaaaaacaaaaaaaaaaucccuguccuuucauauacuaagaggauuggcuacugaaacaguucauugcaagacacaugaagacaacauacuguggcaugaguuguuuuaauuuguugugcuguuacuaaaguucugagggcugugguucaaacauuccaaguucucccuuccaucuuuauugguucucaaaauuuuguacagaaaacucuuugggggcuagaacagcaguacuugcaccacacuguuuccuugacuucaaguuucaaaagcaaauuguuagaaaaaaguuccugauuugacuuagauacagggacaaaaaauagcacauacuugaagauuacauguucuacaaaugguggcaauguuuuccuugcgagaauaguuucguugguauauauaucuuaaauacucaaaaaggcucaaccucaagcaguaauaaacacaagcaaaagugauuuaacccuuaaaauaaauauucagaaaaccucucuguacauacaagugaaagaauauguaacacuuucacgcaaaaaaauaauuauaauaauaauaaaggauuuguucauauaugcagcugaaaucugcuguuccagcccacaauguccccaaugaagaagggaggcacagacauagaugacuacugugguucacuaucuuacagccuuuuuguacugggauacuauuaccaucaaauuaucccucuuauauuuauuuuuuaacuuuuucuuuuucuuuuucuuuuucuuuuuguuuacagcaugccaaauccuuuggcauaugugauggccuucaacaaucucucuuuaaguuuuucuuugcuugaauauuccggaaguaaaaggacauuaaagcaaguaugagauguagguaaccuaaauaaagagaaagggaaaaacaggacaaucaugagucauuggaaauaugcucaguguuaaaugcuccuauuagauacauaucuuguuaggacgguuuuuaaugagaaacuacagauuaaauauaucauaaacauuguacuguuuaguuaaaaagaucaguugggucuuuauccuaugaaauaaugcaaaaauuaaagugaugcugaugauaguaacauuuauuaucuauugaguuuccacucuguuaccuauugcuuuagauacuuuaacacugaaguucauuuaaaucuuuacacaacaaacaucuuacuaaacccauuaaaagcugaagucacuaaacaacuuacaccaaagauuaaaaauuauucaaaccuggcuuuuaaagauuuugaagucuaugcucuguauauagauuugaaauacugcuggcaaaaugaaaaugauaaugauugauuauaaauuaauuaaaauuagagccaagauguauaaaaugucuaauuaacaguaauaaaaauauaucugucgauguauaucgaagucuaccuaggacauauuguucagccccaccauaaaauugugaaguauuuauuggagaaagaauacaaucaaaagucagaaugauuuaacccuagaauaagaaucuaguauaauguaaaagaacagacaauccucuaaauuuuaguguagccauucaaaguagacuguucuauaauaaggcuuucuuaauaaacuaugaaacaaagggggaauaaaacauaacaacuugauaacgucuguacuucuguaagcuccauaauuacuuuuuaacuacacuaauuuuuaaaaaaauuccucaaaucaugaagggaaaauauccauuccacuaguguuugcugacuuagauauuucaauauaacaucagaagaguauauagaggcuacauguuggcucugcuugcguguauggaauauggugaaaagguuuacaguggguacaaaguuggaguuugauauuaccuuucugugucugggccauuuuuggcuauaaucaucuucaauuuuccuaguccuccaacaggugcucugucugugccuguuguaaacugcagaaagagucuuuucuguucaucuguaaacgaaugaacaauuucccagaacucccuaaugugaaaagagaauacugguuuuaauuugacauccacuauaaacaagaucauaguacuacaacauuaaggccaaugucacagugaauauuaaaaguaccauuuacacuuaguauguaaguuuuagucagccagauuuuauaucuuguaggaacuauauaugggauaaauauuaauaacucuuuugcucaguaauucuacuuaaaaaguacuuuuguauuccuaaugcuaagcgugauguuuuaaaauuuacuuuuguaaaaaauacauguucaauauccuauucacauuucuaaaaccucaaucuaaaaaucuaucaagaucuucuccaaagcaagagaaaugugcaauaaauauaucuguaaucuaugcugagaauaaaauuggaaaaucaaguaauaaauccccaaaguaaaaguagagagaaauaauacacaagauaagcacaguuaaggaucagaauaggacaaaaaaauuguagacacuggaagagcggaagaaagaagugacgaaacuuuccaaagaugauagaaauaccuggugaagggauuuuaauuuuuaaaaaauuguaagugaaaaguagaaggcauugaaucacauaaagcagaaccaaauauuaaagaaacagcaguaaaagguuuuccuucauugagaaaccacuuaaagugacuguacuaugcuuugcuaccccaugacauuuacuaagagcagguccaugggaggaaauauauaaaaaaguaaaugauaaaaaauaaauuuaaguccaauaggaauauuaugaagaguucuucaaaugagaaauaaggcuuuuuggaauaugaaacuauuuuuaaaaaagacugagucgugaauaauauaaacucuaacaugaaaaguuuaacgauggcaucaugaaucaaaaauaaagagauuaaugaauucaaacagaaauaauaacacuugaaaauacugaggcagguuggugagauggcucagcagguaggagcacagacugcucuucugaagguccugaguucaaagucccagcaaccucaugguggcucacaaccauccguaaugagaugaucccucuucuggcgagucugaagacagcuacaguguacuuauguauuauaauaaauaaaucuuuugggccagaguaagcagagugaccggagcgagcagagguccuaaaacuucaauucccaacaaccaugcgaaggcucacaaccaucuguucagcuacaguguacccauauacauaaaauaaauaaauaauucuuaaaaagaaaaaagaaaauucugaggcaaaugcacaucaacucuagaaauaaaagaugauucaaaaaugagguaaguaaaugagggaaguguaguaauuuguauuugacaaacauccaacauuucuacuugacaacagucuagaaacaaaaagcaagcaaaggguuaggaagucagaaggggaaaggaguuaaaacaaaauauucaaaacugaagaaaugcauaucaaaguaaaauggaaacaaauuguuaauugacuaaaaccuuucacuugguaaaaaacccuaacaaguaaagauaaaugacauuaauguagagaaaauacuguaaauuacuccagagacaaaugucucucauguacaagaaaaggcaaagggaaaggaaaucuaaaaaguauuccuaugauucagcauuuugaagguugaggcaaaagguaggcaaguucuaggcuaggcuaugcuacaagcaagcuauuguucaaaagaagggugugagggggaucaauaacugaacaauaaaaugaguaagagacaauauuaaaaauaugauuagguaauauaaugaccuugaaaauagaaaacuauacuucaauauuaugugacagcuggaagagagcaaaaaaguugcaaaguaaccucuauguuaauaagggauuauuuugauaauauacuuaaaagauucuuucuagguuuguuccuugacaaggccuuaccagucauaacauuaaauaguaagucuuauuccuggaugcaguuuucuaauaauuucuuuuaacaauguuuucuuacaggguaggggauaauguucaagauaaggcaaaauuucaaauuuuaacaaagucaugugucauguuaaagauacaccaacaccaagcaaaguccuaagcaaggcuaaaguccuaaugguaaaacacauuuacuacauuaaaaguaaauucaugaguucauaauaucugaaaacaaaaaaauuaccauauuaucucuucaguaucaaucuuaaauauauuugacuuugucuuuucaauagauugauaucuuaagguaacaauauaauaguugauaugaaaaagauaggaaaauaggagaaugacauaugucagaugacuagauaaaauuauuuccuuaaaucaccauuuuuauaaucacaggugaaaucaucaauuaaggaaagacaaaaaagauauacaaggcaaaggacuauugaucacagcaauuuuguuacugcuccacaaucucuguaaacagagcaaauuuagauaggaaaaugagaggucaacaauuauguuuuguuuauuuuagucuucugaaaaggagacagaauuauuucucuuuuuaaaaaaaugaggagggaguuagaggaacauaaaucagcaagcagugcugcaauggauccugcuccaaguuuccuuaaugauggauggauuaugaacuggauggguauaaaaauguacaaagccgggcuggagagauggcucagcgauuaagagcacugacuacacuuccaaagguccugaguucaaaucccacaaaucacacaaccaugagccaccauguaaaggaaugugaugcccucuucugaugugucugaagagaacauaaaaauguacaaagccucaaaugacauagagaaaguaugaauauuucacaaaagaaauguuucuccucauaauaagcaagagacucuucuaagaacaaaaagauucagucuugaaggugacuaaaauggagaaagaaaaucagaaaaaaacucaaaagaaccgaggaggaaugaccauguagaaaugagcagaaugugcuuuuacaaaaaaaaaaaaaaaaaaaaaagaaagaaagaaaagaaaauuggaccugagcaaauuaagaauauaauacacgagccaggcgugguggugcacgccuuuaaucccagcacuugggaggcagaugcaggcagauuucugaguucgaggccagccuggucuacccagcacagccagggauacacagagaaacccugucuugaaaagcaacaaacaaacaaacaaacaaaagaauauaauacacggacugaagaaccauugcaacaaggacaggaauauugacucaagguuaagaagaaacaugacauuuaaagcaauguguacuuuuaaagaagcuagggaagaacaaucucuaaacagagucaacuauaacuacuaacuccagagauuaccagauggcgaaagguaaacggaggaaucuuacuaacaggaaccaagaccacucaccaucaccagaacccagcacacccacuucgcccaguccagggaaccccaacacaccugagaaccuagaccuagauuuaaaagcauaucucaugaugaugguagaggacaucaagaaggacuuuaauaaaucacuuaaagaaauacaggagaacacugcuaaagaguuacaaguccuuaaagaaaaacaggaaaacacaaucaaacagguagaaguccuuacagaaaaagaggaaaaaacauacaaacaggugauggaaaugaacaaaaccauacuagaccuaaaaagggaaguagacacaauaaagaaaacucaaagcgaggcaacacuagagauagaaacccuaggaaagaaaucuggaaccauagauuugagcaucagcaacagaauacaagagauggaagagagaaucucaggugcagaagauuccauagagaacauuggcacaacaaucaaagaaaauggaaaaugcaaaaagauccuaacucaaaauauccaggaaauccaggacacaauaagaagaccaaacguacggauaauaggaguggaugagaaugaagauuuucaacucaaagguccagcaaacaucuucaacaaaauuauugaagaaaacuucccaaaucuaaagaaugagaugcauaugaacauacaagaagccuacagaacuccaaauagacuggaccagaaaagaaauuccucccgacacauaauaaucagaacaucaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaacugcagcccaggcuacuauacccagccaaacucucaauuaucauagagggagaaaccaaaguauuccacgacaaaaccaaauucacgcguuaucucuccacgaauccagcccuucaaaggauaauaacagaaaaaaaccaauacaagaacgggaacaacgcccuagaaaaaacaagaagguaaucccucaacaaaccuaaaagaagacagccacaagaacagaaugccaccuuuaacaacuaaaauaacaggaagcaacaauuacuuuuccuuaauaucucuuaacaucaauggucucaacucgccaauaaaaagacauagacuaacaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcaggaguagccauccuaauaucugauaagauugacuuccaacccaaagucaucaaaaaagacaaggagggacacuucauucucaucaaagguaaaauccuccaagaggaacucucaauucugaauaucuaugcuccaaauacaagagcagccacauucacuaaagaaacuuuaguaaagcucaaagcacacauugcaccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaucaggccucaacagauucaaaaauauugaaauugucccauguauccuaucagaucaccaugcacuaaggcugaucuucaauaacaaaauaaauaacagaaagccaacauucacauggaaacugaacaacacucuucucaaugauaccuuggucaaggaaggaauaaagaaagaaauuaaagacuuuuuagaguuuaaugacaaugaagccacaacguacccaaaccuuugggacacaaugaaagcauuucuaagagggaaacucauagcuaugagugccuucaagaaaaaacgggagagagcacauacuagcagcuugacaacacaucuaaaagcucuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagacggguuuagugcagaguucuaucagaccuucaaagaagaucuaacuccaguucugcacaaacuuuuucacaagauagaaguagaagguauucuacccaacucauuuuaugaagccacuauuacucugauaccuaaaccacagaaagauccaacaaagauagagaacuucagaccaauuucucuuaugaacaucgaugcaaaaauucuuaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguucuggaaagaucaggaauucaaggccaauaccuaaacaugauaaaagcaaucuacagcaaaccaguagccaacaucaaaguaaauggagagaagcuggaagcaaucccacuaaaaucagggacuagacaaggcugcccacugucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaccagagaacuccuaaaccugauaaacagcuucggugaaguagcuggauauaaaauuaacucaaacaagucaauggccuuucucuacacaaagaauaaacaggcugagaaagaaauuagggaaacaacacccuucucaauagccacaaauaauauaaaauaucucggcgugacucuaacgaaggaagugaaagaucuguaugauaaaaacuucaagucccugaagaaagaaauuaaagaagaucucagaagauggaaagaucucccaugcucauggauuggcaggaccaacauuguaaaaauggcuaucuagccaaaagcaaucuacagauucaaugcaauccccauuaaaauuccaacucaauucuucaacgaauuagaaggagcaauuugcaaauucaucuggaauaacaaaaaaccgaggauagcaaaaacucuucucaaggauaaaagaaccucugguggaaucaccaugccugaccuaaagcuuuacuacagagcaauugugauaaaaacugcaugguacugguauagagacagacaaguggaccaauggaauagaauugaagacccagaaaugaacccacacaccuauggucacuugaucuucgacaagggagccaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuuguacuguaagaucgagaauugacaaaugggaccuaaugaaacuccaaaguuucugcaaggcaaaagacacugucuauaagacaaaaagaccaccaacagacugggaaaggaucuuuaccuauccuaaaucagauaggggacuaauauccaacauauauaaagaacucaagaagguggaccucagaaaaucaaauaacccccuuaaaaaauggggcucagaacugaacaaagaauucucaccugaggaauaccaaauggcagagaagcaccugaaaaaauguucaacauccuuaaucaucagggaaaugcaaaucaaaacaacccugagauuccaccucacaccagugagaauggcuaagaucaaaaauucaggugacagcagaugcuggcgaggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaagccccaacugguaagaaggacacaugcuccacuauguucauagcagccuuauuuauaauagccagaaacuggaaagaacccagaugccccucaacagaggaauggauacagaaaaugugguacaucuacacaauggaguacuacucagcuauuaaaaagaaugaauuuaugaaauuccuagccaaauggauggaccuggagagcaucauccugagugagguaacacaaucacaaaggaacucacacaauauguacucacugauaaguggauacuagcccaaaaccuaggauacccacgauauaagauacaauuuccuaaacacaugaaacucaagaaaaaugaagacugaaguguggacacuaugccccuccuuagaagugggaacaaaacacccauggaaggaguuacagaaacaaaguauggagcugagaugaaaggauggaccauguagagacugccauauccagggauccaccccauaaucagcuuccaaaugcugacaccauugcauacacuagcaagauuuuacugaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguaaagcauuggaaauguaaaugagcuaaauaccuaauaaaaaauggaaaaaaaaaaaaaauaaagaagcuaggacaaaaacuaagacaaaaaauaguaaaaaagaaagaaaaugaaaaccuuugaauugaacagagaauaugaagaauuaaucacauuaaauaauggugauuuuauucacacugauaauuaaaaaaauuuuuugaaagaaaaaaaaaacaacaguucguugaaaaagaaaugcaaaaaagaacagcaaaaaggacagcuaauagaccuugaaacaaaaacaaaaaacaaacaaaacaaaaacaaaaaaaaaagcggaaaacuuucauauagcaaugguuccagagcaugccaggaaaagaaaaauuaggcuccauuuacugauaaaagugaacaugaaaaccuauuugaaugaauaguuaaaaaggggauauggcacaaagaacugaagaacaagaguuauuuccaauaaacuuaacuugaacuaaaaaagaacugaaguagcacuacaaaagaugaggagaaagaagggcaguagcauuaugaauuacuacccuaugaaagaugaagagcaaaccaaaccaggagcuaaguaguucaacaagccauuauaaaaauauccaccaacuauucaagugccccacuuagauuuaaaguaacaggagauuugaagcccgaaauuacaaggugauuggugggagaaauaaugcggggaggagaauuuggaggagauugaaagaagcuuauuggaauuuaccagaaaauggaggaagguguguguguguaaaccaaacaaaaacaaauguuaccuaguugguuaauagcucaauuuuuacuauagaaaguaagaacuaauugaucccugaucuuuuaaucuauuaacauguuuucucccaggcauggaacaaaucauuuuucucuuuuguagcacacagcagcaggucuucuuuccuuucucccuguuacuuaaaguuucuuaguauagacaucuauucuguaaaguggcaaaaaaaaagggggggggggaccagagguaacacuucuuuuuuugcuuuguuuuguucuguuuucuuauguuggcuuauuuccucuuuauagaagaggaacuaaagaacauucuucuacaaaugaaaaugauaaucacuauguugcguagaaguuuuguuugucaaggaugcaaaauuuauuucucuugucaaaaccuaaaauagacuguggauuuuccacguuuauagcaauugaaauauauauauuuugaaugaauaauuacuugagcuuuuacaucaaaaauuauucuaacauaaaauacaauguauuuggaacuguucccuuugaauggccgauuuuuaauaguaguacuauguaauuuugauuguuauaguuucaaagucuuucugaagaagauauagugaugaaguggucuaucauucuuuucaugggaaagaagcauggauaagaacaacaacaaaacaaaaaaagccaaggaaagauuuuauuuuuaaaaacacguauaauauauaauacuuacaaauauaugauaugacccugauggauacauuauaaaaaaaacuguaucuguacugcauguagaagccaagauuuucaacauaauaaggccucaagaucuaagagaauuagacauaggcaaaacugacacaacuuuucauuuaaaauuuuagaaguagggcuggaacuuauucgguggcuaaaagcaccagcuacuauugcagaggauccaggcuggauucacaaccccuauaugauggcucaauuccagugucagggaauccaacuccauccucuagccucagugaacacugcauacacacauugcauagacucaaguaugcaggccacucauacaaaaaaaaaauaaaaucaaaucaaaaaccaaagaauuguuauuuuuaaaaguauuuaauuaccuauuuucuauuguugaguuguuucguauuuuaauuaacugaaagaauuuuauuuuacaguauaaacauauaguaauguuauuuuaaaaaauaagaaacaaaaauaggaaucaaaauaaaacacacaauuuuauuaaauaguauaaucaugaaaacuuugucaauaucaacaaaagaugaaaacuauaaagacaagaaaauuagaaauacauaguaaaaacuaaaauucuaaaauaaaggcuaugaaaacaauaacuagaucagaaaugaaguuuagaaaaccuuaacagagaggaaccuugaaaaaaugugacagaaauaagguucaauuagaaauaaauuuuaaaaauuauaacaaauacaaagaaacuagagauaaauucaaaacuauacacaacuaggaauauagacaauuuuacaaucuuuuacaaaccuaaaauagaaagauuaaaacuaugaagauucaaaaagcaauuaaguugcaccaugguucaaauauacaguauuaaugggcuaugggcaaaguucugcuaggaauaguuguugcccugaagugcucuccuauccuuugagucuuagagacccuagguaagacaaagauaaccacauaggcugagguacuguuagaaguaccagcaaaaagaagcuggcaagaagcuacaugaaguauauauucgccaacaugcaaauagcugaggaauaguuuuccucuacucaaagacaggaaggagggagggagggagggagggagggagggagggggagagagagagagagagagagagagagagagagagagagagagagagagagugagucucacuggagaaacaugccauucuuauguguggggcccauauccaacaguuaguugaccaacacaauggcaucugcagagguucuuggucucauaauguuaauucaugguguuucucccccccauaucuuaaagguccucugauuauguauuagagcuucuaguuuugugaguuuugcauuuuuuaugagauucucuaguacacaaauaugugugucucuacaucuauagaaucaucuagaaauuuuucucuuugguucuuuuucuugcuuggcuguugcguuauccuaauuuguuuguuguuuguuuaucuuuauuauuccuugaugcuuguuugcuuccuuauaagagucagaaaaggcagggagcagaugggaggggagguguaggcaaucuggaagggguaggaggacagggaaaacaauaaauauauuauauggaaaaacaauccauuuuuaagaaagcccucaaaaaauaaaacggaaacuaucaugccaagaacaaagaaauuaaaacaacucaugccaacagaaauuaaaaaauuguuugaauuuuacugacaaggcuuuuaaagcaaugaaaguaauuauaagcuuauucucagaaaugaacaaugaaauaaugcauaagaaacauauuauuuaaacuuauucacuaaagcauacauuauuucaacacaaaaauuacaaaucaaugcuggaugaaacuaugguauaacuaaauggaaagugcuaugccaugcuugagauuuagaaaauccaaagugaugaaaaugacaauucucaaauugauuuauccaaucaauucaacccaaaucaaaacaucaaaaauaaauguuauucauguaaaauucagcaaacagauuuuaauauuuacauggaaguaaaauuagugaaaacauuaagaacaaugaaaaaguaaagggauucucaccaucugauauaaagacuugcucuuuguucuaucaagguaaaggagucaucaagaugugauuuugaucaaagaacaaaugaauaagcagagaagaaccaagucuagaaguaacucacacaaaacucaauuucaacaaaaauaaaauucagugggggaaagaaagcugcagacuagaauaacacauguauaacauguuugcauaugauccuuuaaaaagaauacauuccaaaagaaauaguucauaaucaguggaaagaagaguggggaagauaauucacaaaguaaugguuaaaaggauggaccaucuagugauugccauaucuggggauccaccccauaaucagcuuccaaacgcugacaccacugcauacacuagcaagauuuugcugaaaggacccagauguagcugucucuugugagacuaugcuggggcuuagcaaacacagaaguggaugcucacagucagcuauuggauggaucacagggcucccaauggaggagcuagagaaaguacccaaggagcuaaagggaucugcaacccuauagguggaacaacauuaugaacuaaccaguaccccggaguucuugucucuagcugcauauguaucaaaagauggccuagucggccaucacugcaaagagaggcccauuggacacgcaaacuguauaugccccaguacaggggaacgccagggccaaaaaaaugagaauggguggguagggaaguugagggggggaggguaugggggacuuuugggauagcauuggaaauguaauugaagaaaauauguaauaaaaauauuuuaaaaaaagauaaauaccuaaaagacagcucaugauccugagucaucagugauaagcaaauuuauacuaagguaaaauuuuauuucacacuccaagacaacaugaccaaagauuaaaagagauacagaauacguucuagcacugcuugucaucuuagguaaaauggcaguaucauuuuacaaaagcauucuugcagugcuucuuaagguuaaaaauguuauuuacuucacaaccacaauccuccaaagugcuucuucaggagaaaugaaaacacuucaacacuaagaaugaaaacuuuauuuguaacagccccacugucaugauaauucuauugccaauaacaaaaggauaauaaucaaaaugcauacauuaaucauaaucaaucuaaaacauuauuuugccauauuguagagauaauacuaggauauucccauuaaggcuucuguauuaccauguuuaucccuguuaugaauuaccuuuaaaacugagcagcaauauaaugguugccacuuuugugacugguguuagaagcaaauaugaaugauaaauuuuuauauucauuaauaauugccauugugcuuagaaaugauauaucauaugacauguuaugguuuuuguuuugcuuuacucugaauuuuguuauuuaauuaccuaaaagcugaauaaauaacauauuugcuuuucuauuaaaaaaaaaagggcaaagcaagaguaaucuucuacaaacuuaaaugaauaaaguaauacuguaauauaaauauaacaaugauaauguaucauuacuagacacaguuaauauucauucuauuguuaacauauuugagucuuauagcucaagugaucuacaaaaagauaacuguuuaaauaccuaugacaucauaguggaugccaaaaagacuacucugcauuuugaucagucacauuagaagauggggggaaagaucuuucagaauuggauaguagcauauuacagaaguagaaauaagggcauuugacuagagaacgauguuagugguaauacuguccuaagaauuguucagaaucacuaguauacaugguucuucccaaguaucuuaaagacuaaauaaugugccaucuuacacaugaccaaaaauaaggcaaaggguugagaaaauaugagacuuaaaucauuuaauucaugaaauaaagcauuagacugcaugaaaauuggaaauauuaauacaggucuauuuuugagcuuacuuguuugguaaccaguaccuacagauacaggacacaaaagcacacaucuacauguuugaugaauaaaaucuuccuuuuuaagaauuaaacaccuuaccuaaucacaacagauucccucguauagccaccgucauacucuguaguuucuucuagugccuggaaaucuagauucugaaaauuauagggggaaaaaaaagcaccuuaacauccauaguacaccaaaacaaaaaacaaaacaaaacacccaaaacaaaaaaaaaaacaaacaaaaacaaacaaacaaaaaaaagaccuuuuuuguauaugucuuucuuacccggcuuccacauauaagcaauucaauuucuucuggucugaauaaguauuuuaagggcgauucauuagucaccauaugaaaaccucugcgaaaugccuugaauuguuuuucuacagauuuauugagaauguagucugaauagagauugacaaauuccuguaggaauauuaacaagaaagcauauucuauacaaaugaaacacaauuagcuuuuggacuaguuuuaauacccacccuccaccccaagaaaaccuucagcaguauuuuuuuuguuacuauguuuaaaaauuagauuucagagaguugguucagugcuuaaaaaagcauuagcaacucuugaagaauaaacauaagucuuaaaaaauuaaucacauguuauauguacaaagaaaauuauuuucacaauuucucacuucugacagauauaaaaguuguauucauaugcauaguuauacauuaugauucuaugaguaaaucaaagagaaauuauauaaaauguaauuaauaguaauaauaaugaaauaauguaaacaguaagauuaaaauaaaagauuuaaaaagacuguauauauauauaacaacagaaccucuaguaugcaauauaaauuuguuaugaauacugaacuugagaaaaccagaaugucucagguuuccucuggaaauuaugguacugguaaguuagcuacuguauccagcucagcaaaaauguuauuuguugguaaacuaagcuauuauaacaaauuauaaaauuuuauaguuuuuauaacuacuucaaaccauacuagguaauucuuugaaaacuuuacaaauuauaaaauuuguuauaguacaaauguaguuuguaucaugacaguacaauauuucaccaaaaauaauaguauaaauuaauauaucuuaaaauuauacuauguaauauuuucuuuugaagcuaaguuauuuccuauugccaaguaaauagcuuuuaaaguuaguaaaaaccaaaucuaaugugaauaaucugauaugcauaauuagaucucaugacaguacaauauuucaccaaaaauaaguauaaauuaauauauuucuuaaaauuauacuauguaauauuuucuuuuuaagcuaaguuauuuccuauugccaaguaaauagcuuuuaaaguuaguaaaaaccaaaucuaaugugaauaaucugauaugcauaauuagaucucaaauggaaaauguauauacacacuaaaccagaugucaaucacugggcucuguauaccucuuagguuuaauaugguaaggcccuguuucuagcguuacauuauaguaauauuuacccauucaaucuuuuguagucuguuuagucuuucucuaaaggggaauuaacaauucuguacaaucacauaagcucuuaucuaagaggaaaguguagcuuuacuauuuagauaaauuuguuuauguaaaguuuuuauaacugcuucaaaccauacuagguaauucuuugaaaacuuuacugcuuugaaauuauauauuuauaaaacaaugacaaaaauuuaauuaccuuccuguuuucauuuguaauuggaauuuuaucaccauuuucuuuuagaucauacaucauuggguuaccaaaaagaucugucugugauaucuggaaagugaucaucauaucaucuuccacacucccuucauauuccaauaaauccuuuaaacucugauauaaaaccuaacaaccagaaagagaagugagguugccaaauaaauacuaaaagaaauaaaaauaauagauuguucauucuuuguagaaacaacuugucaacaaaaaugaagccauaaauauuccacaucucucaaguaguuuaauaagauagaaagguugucacaggcaaugggucaaucuuaaaaauucuucaaaugaucaguucagcaacagauuucauaccauggucuagaauauacacuuucucuccaugauuguggcaggguacaggaaaugaggaaaaacaaacaaacaaacaaacaaacaaacaggaaaacaaacaacaaaaaagccacacacauaucaacuguaccuaucaacaacuuuacuacauagacucauaugggacauugaaaacaugauguuuucaacauuuuuuauggggucaaucaaaacauacuugauaggauauauaaaaaaugauguuuauuauacuuaaccagauuaaaaguauuuuacuuuacuaaacagcaguaucaacaaaaguuuacaaauaaauaauguuccuauauaaacugagauaaacuucuguauuuagauacaaucuuaaagacuauuaacgaaggacaacuuacugggugagagucucccaagucacgaaagguuccuuuuuuccccauuagcuuccuguauacaaccaugggaaaauggacauccaguauacaauuauuguaaauagccagacccaggacuaugccaaucagaguaaacugacccucaguuucaaaagaagauggauuaaaccaaaauaauuucguagcuucaucauaugugaacauaccuauaaagaaauaauuaaaagucauuuuauccacuuaaugacugaaaauuacauaugaaacaaaugcaugauuaaguaaaaaaaaaaaaaacaauuggagaaaguugauuaacuuuaaguuacuuaaaauucauaucaaaucuaagcuaauauaauuuuaaaaaauauuuugugaucuuucagcuucacaugaucuucauuauucaaagccaaaguccagagauuuuuuuuccuaucaucauuauuuuaucuaggugaacauuaagagauagucuuuuuuuucuuuuuuuacggaacaucaaacaauaaaauaaaacaaaacuaauuguauaugccuuucaauuuuucuaaguuuauuuucaguugcuucucaggaaauacuuuuuauacaaagucuaacaagcugggggagagagugggcuguauaccuuagcacuugguaaaaugaguaaggaaaauuaugagcuuaagguuagaguacuaauacaauauaaaaagauugucuaaaaaagccaaaaucaaaaugagcaaaucaaaaaguuuugggaaauguuuuucuaauggaacaagaguauuaaaaaacaaauaauaaagcauuaaaauguacuuucagguuaauuuuaauauuuaaaauguuuccuuauuuucacuuucaguuuuaauuaaaaagaaaaguacacuuuucuccuugaacuguaguaauauaaauuaagucuaagcuuuuucuugcaauuuaauauuuguggaauacugguuucacaaguauucaauucauacuugcauuccagcuugaaaaaugugaguuauguaugucuguaucauuugcaugccagguuauacauccagguaauaucaaaaguuccaguucacaaauaauaaaucugauagaaugucaccaauggaugcucuuggucucaaggacaauuaagcuauaaauuaaccagaggauaaauuauauaaccuaugauucucaugacuucagguuuucaaaucuaccacucuaagguuuuucaaauuaaauuucccuagaaggcaacuguguucuacuagaauauuugacuaaguaauauauggaagaaccuaaauuaagugagugauagaacagcuccugaagcagggauauggcauacucaauuuuuuuacugcuuaccauaacugaaaauauuuauaaaccaaguuuauacuuuaaaagacuaacacaccaucauaaucauaucacuaauacuuaccaauaucuggauuaaaaauuuccuccacaaccaacugaaaaaacucuuuggaaacgccucccucaucuacuccuuguucuccuucaaauuccacauacaacugcuucuucaagucugcaggauuuuccauagcaaucaucucuagcuguugauugaaaauauaaaaaagaggacaguugagaagaggaaaaauguaagauauaaguagaagaaaauaagaagcagcaauaacaaaacaauauggaaagaaaacaaugaauuuuguuucugaaaagaaaaaaagcaaacugacuuacaguuuuuggcaagauuuauuucaacacacaagaguauguacuguguuuaagaagcuaugcauuucuuaguaaaggauauagccaaaaugcuguugggggugggguggggggaauaguugcaauuauguccuguauaucuucaucuuuaggggucuaagggccuaugaauuuauucuguaaagaaucucuauauuggucuacuuuaacuaauuuguaugucuucauguauguauauucacaugucuccuuccaccuaagauguauuuccucaggaucuguccaccuuguuugucaggaaaggaucucuccuugaccuggaagacugcauaacacaauagguuggacugucaauggccccuggcaucucugccaguaccugccuaccuagcaucaggacuacaaugcccacuucaaguuucuuuucuuuaauagaguucugaagauuaaacucaguucuucuugcaaguugaucuaccuucucagcucgcauacccaauuuucaggucaguauucauugaaauuuauuuucagcaguacuuuguuggugaacauauaagaaacuguucuuucacaaguuccacauaucaccacuaaauauuaacauuuaauuacuaagcuucaauaaaucaauccuauuuucuaauguauuacagaaacagagguaauauucuuccuacucuaaugguauaugcuuaauauaucauuucuaaggagcaaaacuguuaacauauuacccuucaaaacuauagacuuuuaaaauucauaaauuuauguccccaagaaauuaauagguaggucugacacuuuacagccaaauauauagauuugaauuuaaccuuagaaauggagaacaaaauuauaccaacaacagcauuagcuagaaaccuguucuaagacagaauaacuuuguacacuuaaauuuccaugaucaucuuagcucaaauuuggucccaacacaauauacuauuauuacugugguuucucccaguucucaacuugcuaagaaaacauguuaauuauugauucaaaggcuuguugguuucaagacagcauacaucuguccagucucuacccuuuucccccaauucugguucuaguauguucuauuaugaucacuaaaaauaauuuucuauauuuuugcuuucguuugaaauguaaaauaagcauaaugagauaguaucaaauaaauaagugaaguguguaaauuaaugcucuaccauuaacucuaaguuugaaguugcaaguauugucauucuaguaauuuuuaaauauuccauguuuucuauauaugauagaacaagcauuucaucccagcacucaaacucgguaaguuuagugcaguuaugucuacacagaaaaucugaguccagugagagcuuuauagugauucucuaucuaaaauaugauaacaaguaaauaaguauuuccaguuuugcuagaauauuuaaccacaugauuuuaaaaacagaaguauucccggaauaagagcagcagcagcaacaaauuaugaaacuuacagcucacuuuacaauuaaaauuguucugauaucuacaacuccuuagcaaguaggcugcuaaaaccauuuuacagaaagucccuugaaguaauaaaaggauaaauaacuuaagaaauaguaauucagaagagaaguuuuaauccagggagcaagcuuauagcccacaguuuaccuacuuuuccaaagaaaauagagauaauauuugcuuuuagauuuugugugacuucuuuggauaucaauauuuucaacuauauucacauauuauuuucagaaucaggauauauuuguauauaauuuaaaaauaguuggcagcuuaauucuguaagugaaaauguccaacuagcaauuuaagaagaccauucucaauguugccaaagugacuuuguaaauucuuauuuuguuugagaugaugcaucaguagccugucuuuuuaaaaacuaugguaacaaaacaaaacauaaaauuuaauacuaaccauacacaaaagccauuagcaaagaaagucacauuauuuuuuuuuccuuaaauauaguaacucuugcugagaggugguagcacaagccuuuaaacucagcacucaagaggcagaggcagguggaucucugagaucuagaccagacuagucaacagagcgagcaaguuccaggacagccagggcuacauaaacccucucaaaauacaacccgcccaaaaauguaacucuuagaagagacacacacacacccuuaaaccauuguuucaucaacuaaagaauaguauaaaaaaaaaaauuaaaguuauauuuuaaaaaugaauuuguaaaaucaagcugucuuacauguaauuggauacaugaaaacuauugggauauacuuaaaauucugaaaaaaauauaagacaaaauagguaguauuggcuucauagauagcgcuggagaaaaaauacacugguauuacuaugcuguauuaauguacaauaguaacuaucacuuccuaacuguacuucucuucauacuaggaaaucucacucucaucaacuguuaaaauauuauucuuaauuuauuuggcaauacaaaauccuagagagaucauuuuuuacaagcugaccuuauaggagagcauuccaagaaaucuaagcagaaugauauacugauuuaaaaaaaaaaaaaaacauucuauaaccauaucuucaaggaucaaaaaaaaauuuagcgccaucauuuaaaaccuuuagacagggcuggagggaugauguaucagcaguuaagagcacugacugcucuuucaaguccuaaguucaauuccaagcaaacacuugguggcucaaagcuaucuguaauaggaucugaugcucccuucugaugugucugaaaauaaauaaacaugaaaggaaggaaacaaggaaagaaggcgggcaggcaggcaggcaggcaggcaggcaggcaggcuaaauaaaaccuuuagacauccagaguuaccaucuaaaauccuauguuaacauaacugaaaacaaaaaacuacuaaugauacuauuuaaguugaacaacacucaaauuagcucuauuuaaaaauguuuagacucuccaagaagaguaauuuauacacuuugauaaaaaucuaaauaugacuuucauuucuauaaguaaaaaucucucuaaauuucuuucuuuuaaauuauuauaugaugcuaagcucuuaucguacugacuacuucaucucccauucugguuguaagaaauuauuuugaagauaaagggaagaggauuccauuaauuucuuuuuuuuuucuuucuuucuuucuucuucuucuuuuuuuuuuuuuuuuuuuuuuuuuuuuuuuuuuuuacacgagacaggguuucucuguguagcccaggcuauccugaaacucacucuguagcuggccucgaacucagaaaucugccugccucugccucccgagugcugggauuaaaggcuugcgccaccacgcccggcuuccauuaauuucuauuagaauaauuuuaaauaagagaaaucacauuaaguacaauucuauuaaugaaugaauuacaccuagagcagcacagaaaaacuccauuauuaaagcaauguaugucaaaugauuuuuuuaaaucaaguucuuguugcaauagguauuuauacuaagagaaaugauggaagcucagcuagacaaugcaucuagacuuucagagaaauugaggaaguaauucaaacaacuuuuucuucaucgaugugugccagcuccuggguuuuuggacuuuucuuuccaauucuacaacuuagcaauuauuuuugguuaacuauggaaaauucuagaacuuaacuaaauuuauucaugucccauaccacugucaacuccuauuuuagucacacugacuucauuauucguuuuaaacacuggcaauauucuacacauggauauuauucaauaauuuauacuuauaaacuguacuaacuguuguuucccaaauauugauuuguagcauagauguaccaaaacauguaaagaacagaccacuacauuuucauaucagaauucuuuuuuuuuuuuuuuccuaucagaauucuuagucugaacuccuaaaaguccagaccuuaaauucuguugcuguguuuuuauuuucugggcaauucugcuuuuagauugugaacgcagucuaaagcaucucgcacauggcaauacugucucuggauacaucugaucuuauuccacuuuuuaaaaaaagguuuuaagauuuuauauaugcuauauccuugaaaucacuuuauuuuuuaaaaagaggagaaaaaugugccauuuauuugcuggugguagaagaaaacaugugccaaggaguuaauuacgucuuguggauuaaacucagucaucaagccugguggcaagugacuuuacccaauaaaccaacacaacagccuacaaagaauaucuguuuuuuguuuuuuuuuuuuuguuuuauuuguuuuuuuuuuuuuuuaagacuguuaaaacuucuacacuaggauuguuguucaaauggaagcugggaucucauuaguauuuauaucuguauaauuuucucguuaaaaaaaaaaggccaaaaccauucaaaauaaagcaaaagaaauauuggaguuuuuuccuuuuuaguagaauuuguagauuuauuucuuuauuauuuauuuauugcuuaguacauacaaauuuuaaaaaauaguaccuuauacuuuuauacugacuauucucuugugagacagaucuucuaaaaauaacaguugggggaaagaguuguuauacugauugaaaauaaugaauaaacuuuugcuuacaaaaaagaauuggcuaggaguguuauacacacauaauuuuagcacucaaguggaaaagauaaacaagaucagaaguccaaggauaggcuaaacauucuuuauuaaauaaaaauaaaaagugauuuccaggacagccagggcuacacagagaaacccugucucgaaaaacaaaaaacaaaaacaaacaaacaaacaaaauuaauucuaauuuacucgccuacugucuaccauuaagccagcuaaucuaauuaacacugaaaugugagauucaauagaaaacuuacaaaagucacauauguaaucuuuucuaggccucacuuauaaacuaaggagaaaacgguauuauuuccuucauagcucaagguuaggguucuauaaccuuucuuucuuucucucucucucucucucucucucucucucucucucuuucuuucuuucuuucuuucuuucuuucuuuauauuuauuaauguugaguucacugcaaaacuucucauuccuucucuauacaaccuuacuaugcaguucaaaaugaccgggucauaaaagauugugauuaacaugaauauucugccaaguuuuuuuaugaaagaaagaacaagguuucaaaacaauagggauuuguggagaauaaagacguggaaagagaguagaauuccaucaguucauauguggguauucuuuugaauacagcuugcuguaaaccuccaccuuuuugcuauuaaucuaauaugaauauaauaauuauccuuugcucagggucaucaauuugaucucuaaagucugagucuuugcuucuauuucuaacccuuucccacuaguaugcugaaaaaccaagaaauuuuagagggguucaguugaaaaugauccagaaagagaaaaaaagaggagaaguggaaaagaaagcaauauaggacaaagaagagcugggugaaacucuuaggaauuuucucaaaaaguaccuaucuuuguaauucuacugcuuaucaaugagacaaacacacagaauugaugaaggccagggcuucuauaaaauacuacuagucgaauauggauauuaucaaaugaaucaugucaaaccauaugacuaguucacauaaauaagauuuacuagcaacaguuuguuagcauaauuacaagacucaacuguuaauuuuacuccaacuacagaaggggcuaauuucguccuaaaugaaauuuuacaaauacuauccaaguuuuaacugguucuuaacucaauaacuuuauuauagaaaaaaauaguauaagaagauaauaaaaaaaaaaucagguaggacaggugcauaaauuuuuuauuaaauguguauuuagcucagucuuaaggcuuuucagauuucgacaauccauucccccccaaaaaaaauaaauguucaaauaaauauuauuuguuaguuaucuguuaaugaguuaauauuauuuguuagacuauaaggaugaugcuucaaucuguaacuaguacuaaaucuuacaucaaguuuauacaagaacuagcacuaacaggaacaauuaauaccaagggauacccugaauuacuuauauauaauuuuguuaauaugugacugacaauuuucaaaccaaauuucugguuuaacugacagggacucuguaauuuuugucgucuguagaaaaaaggaagacaagaggcaauguuauuugaaaacaaaaacaaaaaucacgcaguaagaaguuccugacuucccaguuaaaucaucuagauuuaccugguauuacuaacauuaauuccaagcucccaaaauagccacuuuacagaauuuucaagauucauguuauuauuauuuaaaaaaacaaaauccuacaaugucacacaagacagaguggcuuagaacuccaaagucuuauugauaauacagacuaaccuuuccuggucauaucaucaaguucacaauagaaagcugaguuguguuacacauaauggaauuugaagagcagcucuuauucuuuuacaauguacauuuauugcauuauuucuuccaauuccaucuuccauucuuaaaaauguguauaacaauaccauuugucauguguuccaaucuuugaaaaccaaucuuuucuucuuaauggaaauauaugaggcuggcuuucaagauucagaaaauccauuccuuuuacuugcuuugugccugucugucugcgcaucugugugcauauguaugcaugcaugcaugcaugcaugugugcauguaaaugccaaaaggggaaaacguauguguggaggucaaagaacaucaaguaucagacuuugcuuucuaccaacugagacagggucuaguuauuugucaguuuauauaucagauuagcuucugaggauuuuucugucuauacuuucuaucuugcuuuaggcaguacuauuacaaauggaacuaccauauccuguuuuacauguauucagaaaauccaaggauaaguccucauguuugcacaacaaacguuuuaaccacugagucauuccccuaguacuagaaaaaucuauucuucuucaaaagagaauuaucauuagacaaccaggauaccaguauuuuugguaagaagcaacaaagguguagcaauacagaucagaaauguuaacauaauccuauuuuuuuccaaaauuauagauaaaaugaauaaauugaaauacaucacugucuagguuuuaguuuaauuccaauuuuaaauaauagucaaacuuacccggaccagugcaucaucuauaauauggucacgucugacuuugagucucaaauacggauucaacugcuguccuugaacuaggcuguaaagaacagugauucuucuuucacuguacaugcgaauucuauugucauaauauaaucccagauucuuugugacagcauucaauauaaagggacaugucauaaaagagaauuuguucucuguuucaacuuugaaaaagguauaaucuuuguccauuucuagaacaucauucagugguucauuaaugaauucuucaaaggagauaagugguuuucgacagucuagaguuuuaacgccaaguucgguuucuaguggauccacucgaggaccuuucuuauuucuucuuucaucucccagaagcuccugaaguguuaauucgcuggacucagguauggguucuucaucaucuuccucauuaugauuuguguccacauccccucccacuacauuugcauaguaaaccauuuucaaacacuuugaagcagcaacaauggcaucaucaucauucacuagauuucggcuauuaaauucauugcuuaugacuuuguagguaauaaguugcugaaauguuuccaucauucuccgaaucuggucagcacuguauuuagaccacagccuaaucaguuuuccuugagcuucaagggguagcuuacacauagcuuugcaaaauaauggcaacgccauuuccagauauucaggacuguggagauuacuauucuccauuacaauaaugaacaaauugagauaauuaggaucucgaguauacacauuaugauaugucaaaucacauuccacguuaggugacagauauacaagugcauucaggaaggcaguuucuaauuuuucauuagcgagcaaacugcuguagacccuucuaauagcaucaauauccacagucacaucaucaggaccuaauuuuuguacauuguugucucccugugaacuaucacccauccuugaagaagaugcuucugagucuucuuccauagcagcagcagaacaugcagcuuuuuccuuuucaucuucauccuugucuucauccuuuucuugaagagauuucaauuccuccuuugugugcuguuugacuuuccgaaagcucagaaccagugccucagcacuagaaaauauucuuccaauuacacgaauuaaaggggaauaauccucacucucucuacaaaauucauaaauuucauauacuuucucuucaguuagguaaaucacaucuagaaaauggaaagaaaaagaacauuuauguuguaauauacauguuuauuuuguuaaaauaauugcuagugaaaaaguaaaauaucuaaacauucuggacuugauuuagaauuuuuaaaugauguaauuuacuuauuaacaaguaaucccaacaaucucacccuuucuuggcauucauugaacaaaauauaauuauuaauuaugcauugauaauuaagacaugccuuguaaccaagacauguacugguauguaacauuaauuguagguaugaacaaauauauauacuugucauuuccucauuguacuuuauuacaaccuuaacaaaaagcuacuauauaaaauccugaaaucauuuuccuuugcauuguucucaaaaaacuaaggagguaagguuuuauaacaagguuuccuuagccccuucauuugcaaucaacucuuucuauacuuuuguauauacuaaaaccaaacugacucaucuuauguauuccuaauuucuuccagaauuuccauucagaggcugaggaaaagauauuacuacucauguaaacucuacugaaguuaaaacugcuacuacaacuacuacuaccuaugaccauuacucagguucuaacaauucuuaacagagcaacuggaaauuauuacagucaucagucauuuaaaaacaaacagaagaaagaagcuaagaaagcaaaaaccacaagcacuaaaaccuauauuuauuuucucccagaaauagaauugggaucauaaaagucucuagcuucucaccacuaggccaaauguaaauuucaacaaaggcuuuaccauuucagguuaacaaaacaaaagauacuuaucuuuuuggaaaaagguaacauuuuacauauuaaaguuuuagaaaguaauauauuuaucaaauaauaauguugaaaccacuaaucucuuucaccaaagaguaacauauuauaauuauuaaacauuuaaguuaggauaauuuuaugguuacauugauaauacaccucauacauugccaauauaucuaacauguaaaaucuuuauuaugauugcuacauauuauuaaagguaccuaauucaaaaauaagaaacaauauaaaauucaaguccucauugauggaauggcuuccaaaacauaaaccacaaagcacuaaacuauauauacuacaaaccugucuauggcccauucuagaguauugauacuuuuuaauuuuaugaucuucaauucuuucuuuuaaaaaaauguucuauuuacuuauuagaggugaugaggguauugagcugaguugauaaccuaaaagaauuaauuuucuccuucuacagugugaguuucaguaguuacaugucccuaucugaggcagcauggcaagccaaguucaauucuuagucuacuaagaauaaguaaaaaagaaaacacuaacauggagcucauuucucguuauucuaacugaaaaaaauacauggaaucuucuuuaaccauucaagucuaccaaauuucucuaaacuguaaccaaaacacagaaaauaucaguaaugaauaaauaggcagacuguuagaauauaauguuuuaucucccuaucauugaauuauaaaauuaguuagaaagugcaaauucuacauacagaacaauauacauccugccugaaagagaauaaagcucuagauccacacaccuuugauuugcaaugucuuccuuucagagcacagucauuaaaucacucugacauucuaguaauacaaacuacuauucauugauauuuguuccacguaguacucuacuuaaaauguuuaaaauguuuaucuccaucucccccaccccucucaugugugcauauaaaucacugcaaucagaaauaaaaaguucuaaucuggguaucaacaaacaguuaaguaaagaaacuuuuuuuuuuuaagauucaccuguacauucuaauauaugugugcuugaaaacuguuugagacaugguuucacauaguagaaacagaacuggaaaucagcucaaaaucuuuaaaacauaacauuuuauacuccaaacaguuucacgcaaaaacagaguugugauacacuagcugauaacuacaccucuaacuaaagugaacaaauauaauuaucaaacugagggaaacaugauuaagcauauauaauucaaaaauauuaaagaaguaaaggcaauaaaauuuggagugauccacaaaaacaaagaaccuguaaaaaaggaacacccaugggcuaaaacaaggcaacuauauccauuauauacuagauuuuucccacaguuaguugcauucaacuaugaugggauacuauuuuucauuuacuguuacucugucauguccacucuguuguagaaacauguauaauugagccaaugcaauuuucacauucaaaauauugauuagcauucaccuacuuaucuacaauguaaacaaauucaugaaauaggacuggcuauauauuuuugaguagcaaagcugaaaguuuuuuuuucugauuuuucuuuaguccuauugugaaaguaauaucaugaaguuguacuauaauuuuauuucacuaauucauuuaaacauguuucaagugauaguggaacuaaucccuggcaaucugaaacauucaauuacuuccauuaagagaaaaaaauagauugaacaaaaucaaucaugaggcaaaguaggaaauuugaagaauuuucaaaauauagaacuauuuuuaaaauacuagaugcauuggggacauagcuuaaucgugagugcuuauuuuucacucaugaggcuauccucaguaccagguaucagaguauaaaacuuuaauuucauuacuggggaaauagaagugugaguauuaaaaguacaagaauagugccacuuaacuugcacaaaacaaaaugaaacgaaaccccacaagagcugaguaaagacuauuacugguaaguuacgucccuaagcaguaugaaaauaucuaauuccugacguagagagggcagaauguaagaaggaaaaaauguaauuuucagauaacuauugcaaaauuuuacccugcuuucuuaaaaaaagaaaagaaaaaaaaaaaaagacuacuuuacacuuuauauuuguauuucuccuuuuaccacagucccuggaguucuagagccgauacuagguauucacggcaaaugcaauguacauaguagauuuuugugaccuaauaagguauuagcuacaauauaaaucauuacaaacugaguucaacucaucaucauauuaauuuuuagaguauaacuugcuucugacugacaacuaaugaaucaguaaaauauaagaauaaaauguaaacaaacuaaauaccaguccuuuaccacaguuuaccagaaaaggugacuuuuacuauauuauagugcgauaacuuaaggugauaaaaaaagcaaaaacaaaaauaaaaacaaaauaacaacaacaaacaaaaaaacaaaaucaaaacaaauaaacaacccccuccacauuuaaaucugauauagcuuucaauuaaccauuuugaauugaaauauaaucucuuaccuuuaaaaucuuuuccuuccuucuuguucauuuuuaucucugaguuguuagaugcaccuuuugaguucucaagguaagcugagcuugcuccuuucuuggagggaugaggaucacagaguuuugcauuaauuuuauaaagcucaagggcuuuaauagcugcugcauuguuauccauacgaagaaaaguuggacaggaagcacaaaacucauucgugcaggccucauuuccacagcccucaguuaacugaugguaguagcguucuauuagaugcuuugcagcugcucgcuuccuguaccagacauucaaacaauaagcacauuuauuaguauagcucagaaacaaagcccaacagauaaggcaaaaguuagcuaagcaauaaagcaauaaacuaaauauuuagauguagaaacuggaaauucacuacuaccucccaaaguguuaguaaaauaauaaacauuuucuaaaaaaacugugauaaacuaugucagcuuauaagauaauuuuaauauggcaggcuuuucuuugguuuaaaaaaagauaagcuuaaguugaugguauaggacccuuaacuauuuagcagaaaacaacaaaaacaaacuucacugcuacaucuccauggcaguuucccuuuucacuaauauaaaaucacuaauucauuuuaacaguuucaaauacuugauuuccaguuaauaucaaacuucuagagauuaaaauuuuuuacucaguaaguaaucaugagauauuuaaaagugcuuuauaaauaaacuaucuaauuucauauuauaccgagagagaagcaccaaggcauacaaccuugagcccauacuugucacuaucuucauuaaauccuugucauaggaaagauaaagguuuaaacuuccaucaggggaaacucauauucaucuuacuucaucaacuuuaaacauuaaaauuaacauuugauuaacauauuuuucaugcaaaguaaccaauacaauuaaaggaaugaauuauuuuaccaaacaagaaguuguucuacauaaccuaaauucuauaauuugacucuaaaauucuauucuuggagauuaccacaaaauuuaaguugaaauguauaucuggcccauaauaaugucauucuaaggaauccguuugguucuauacaagcaugggaacugcaaguagaaagaaucuaucuaauuucauucuaaaacuucaugucauuauuuuagauagaacuaagugacuaauggcacuagagauaaacaaauauggcacugauaagugacuuuaggacuaugucauucuuuguaugacaaagaaugguaugucauacgauccuaacucauucagauacuuauauuuagaaauauucccuguauauuuaccaugcauaguguacaaaggccaagccugaugacucaaguuugaucccuguauccaacuuggugaaaggagagaacuaauuaccacaaguuguccucugaacucuaaacacaccaaaacauaugcccagucacauguaucuacagaaaauaaauaaaugugaugaaguuuaaaauguaucacgaaguuagagauaccacuuaugagaaaaauucaucaaaaggaagacuuauuucccuauuauuuauggaaacucagcaugcuuaacaacagcaaaccgcuucaauauacugacagcaugcaccaaauaaaauaauuaccaacuacuuuaauuuuguuacuuccuuaacaaaagcuagugaucaaguuauaaauguaggaugaauguuucgaaauauuaacuauuuuucuaaauaauugacugaguuaauucuuccuagcuacguuuuuucuguaaguauguaccuaaacacuaaaaauuucuaaguaucaguacggaaguuuuaaaacuucaucuacgugauuuaaauagagccaauguuuauguuuauauccaggauuuuuaagcguuaauuucaaaguucaaaacacuaguuuucuaagaguacuaggccgcccccccaacccauacacacacacacacacauacacacacuacuucuuuaugugauaaagaacucucaauacugaagggagaaaugagaccauccaaaagucagcucaauguaauuaguugaaugaacuaauuuucuaggccucauuuuaccaccuuauguccuuauaauuugucuagcuagcacucucuacaugccaaauaauaaacucaguacauugucagguacucugauuaucauaugaaacuugaacuugaagauuaucuucugucuacagcuaguaaaagagaaagaccugaaaagaucaaaucuuauaauugaucuuaugcuauguccauuaaagaagucaggacaauuuucagcuucagaauucaauuuauuuccaaucacuguuuuacagauuauaauuucagaagaauuaauucuuaauaccagcaguccuaaaaaguuuuaagggggaaaaaaagaccuaaguaauauauaauuagaaaacaaaaucuuccaaaaaauuccaaucuaaacuuaacaaccauguguacuaucuggguacaguauagaaacuccugaauaaauuauaucacuauacuuaagauaucgguaauuuauugaaaauggauaugcuaagcacuuuauaagaagacucagucuguaacagguagaaauucacaauuuugaggccagauuguuuggguucaugaacaguuucuguaucugaguuaacuacuuauuuagucucuuucugugucucagcuuccucauccuuaggaugccaguauauuucagaauucaaaugauuuaagaauuacaaguguuuagacuauuucaguaaauuuuggaagagguaggaaaaaaauaggaggugaagaugagcaaaaugcauuguaucauauaugaaauccucaauuaauggaauaguauguauuaccugcuacaugcuaggcccuaaugguaaguaucagaugcuauugcaauugcuauaauuucuaucauuugcaugaguauaugacuuggucaagagaacuccauugcacuaaaucugaaaaauuaaaaucuaggcuuaauuccaaaauuugaaauuuuagcauuacuaaaggggagacagcagagaaaauguuugaaacugaccagcuuuuuugcaccaaguuacaaguaguagcccacuaauacuaauaauuauauuaaauuaaauaaacagaggucauaaucaaccauauuaaguugacuaauuugauuaaugugcguuuauuaauauuaaguuaauuaaauugguuaauaugauugaauaugauuaauuaacaauaauaagcuauucuuuucucauuauaaaugauaccauugaaugccaaaugcagggcauauaaauucauuaaggacauguaaaaggccucuaaaguuggaaacauacauacuaauaauagcuuuugauaaccuuccaaugcuaauccauacauaggacuggucacuaaaucauaccucaugugucaaaucuacuuuuuuuacaguugaaguuuagaauauuuuauagucuuaaaucauuaaaaaauuauauuuuguuucaugugugaaaauugcauaaaacuuaaaugucuauguccauaauuucuaauguaacaugguaaauuucaaguacuuguauauuuccuguauguucucuaucauaauguaucuagccaaaaguaaaaugcuuugucaccuuaaaaugaauucccugugcaugccagugaaacuuucaaccaaucaucuggccuccuuacuuucucucuuuguccucagaagaugaauagaguaagguucuuucuuccuacuuaguacuuuaacaaaaagggaguggggaaguaggaaggaacauaaaagaaaaaccaaaguaaaguucaggaaaugaagugaauccguuuccugauauucauaaccaaaacucuacaaaaaggagguagcaguuacuuuugccuauucauauuccacugacuucguggaaaucaaaguacaauauagugaguccuuaaauaaaaauaugccuuuuuuauuuaguuuauaagaaucaagugaauccuaccaguaaaaguguuccucuuuaaauaauaguuuccacuucuuuauuacuuucuaagaagccauuaaaacggauucuacggaaacugauagaagcagaugcagggacccacagccaaacccuugaagaguccugcugaagaggggaagggagccaaaggacaccacaaaaacauagcccacagaaucaacucagcagggcucauaagggguuaacagagacugaagcaacaauuggggagucugaccugggucuucugcauauguuauaguuuuguauagcuugauguccuugugugacaauuagcagugaaaguaagggaugucuccgacucuccugccugcuuuugagaacuuuauccucccaauggcuugccuuguccacccucaaugggaagguuaugugugugccuaaucuuauugaaacuuguuguuaugccagguuugguugauauucaugggaagccugcucuuuaaugacgggaaagaagaggguaguggaucugaagcaugagggaagggaggaggaaagaacugagaggagugcagggagaagaaaaugcagacaggauaaacuauaugaaagaauuaauuaauaacuaauugauguuuuccacaaaugacaauaaagagaaauaauuuucaguguucucaguagcacuaauaacauuauuugcuggguccuaaguuaauuucgggauaguugaauacuuaggaauaguaaguaaaucauaauaaaaaugauaaaguuauaagauauucauaacuauauauagauagcaucaaggagauuauacacuagaagaauaaagaauucccacauaguucagcaugagaaucaaaaacagugaaauagcugccaugaaaacaagaaacagaaacaugaaagagauaacuaacaauaugacuuauucaaaguaucuuuuuuaaaaaaauaagcagaauaaaaacaaagauuggacaaaagagguaagaaacauauacagcccaagacucaauuaacccaugcauaaucuaguaagcacugcuuagugucuuucauagguaaaugucucauuauuuuguaagggguuuuauaaaggauguaccuuuauaaaaaucacuacuccuccaagaaaugguggcuuaugcuuauaauaguagcauauacuagacuaaggcaggaagaucuugaguuuauuaugaacuuuauguggaggaaucaguaaaccaaauuucacaacuugccccaaguuauuuuuaauguagaaacuugucaagaguaaaaaaugugaucucacaaacaccagagauauucauaauacaguuaaaaccaguauaagguagggucuauugaagugucaucaaaucauguauuacaagacugaaaguacaaauaugacccaauuaguaucaggaaccauuugaaagucaauuauauauaaaauaaggaaaauuucuuaaagacagauagauggguggauggauggauacuaaaaaugcuuuuauucaucuuuacaacaaaguacuaguuguaaaaauagaacuguggaauuaaauuuucacauagaauuauuuaucuuuuaaaaugaauaaaccacuguuuuugggguuuuuuuuuuguuuguuuguuuguuuuucaccugcccaguuucaugguuagaagaaaguaaguaaacauuuacaaauuuagaaauugacuaguggagcuggaaacauaguguaguagaggcacaccaccaauauauauuguauaaauauauaaaacuuucaaagaauauuauuuuuuaaacaaagaucuuuuccuaaaaccauagguugacucuucuuucuguaaacagaaggugaauauuggcugauuguagugaaugcuaguuuuagaacuuguauauuuccuaaguaagaauuuugaaaauggaaaucuguccuguauuaguuuggaaagaguuaguaccacugccauacaaacagcagauaccugauaggagacuagagugauggcucacuagucaaaagcacuagcugcuuuuucagaggaacagaguucaguuccuagcaugaugucagguggcucacaaaacugccuguuccuccagcuuaagagcauuaaaugccacaggcacccacacacauauagcaugcauaugcauauaugcauauauauauauauauaaauauauauauauauauauauauauacacacacauauacauauacacauauuaaaucuaaauacagucaaaaccaaugcacaaaacacauuugaaaaagaacacauguccuugcuaaaaucccauuacuuaaaagaaaucuugugaagccaaaaggcuuucagacagacucauuugagaacaugaauaaccacucccagugauagagauaucucaguaguuaagagcacugauuccuccucuuccaaggaauccagauuugauucuccacaccaacaaacuggugcagucagcugugacaccuggaggaguuacacacucaucuggucuccaugggcaccgaccaugcuacauguggugcacagagauauaucccagcaaaccacagauaaacauaaaaaggaggaggaagaggaagaagaaauggaggaggagaaauauuuacucuuaccaccucuaauggaugaaguacaauaucuaggcauagcuaucagauaagaaaaagauaaaagauacaggaacauuuggaauaagaugcaagacuacaaggugcuaaugugauaaagugaaugaaaacuuccagaguaucaaaggauaaauucaaauucuaagagagaugaagaauauuggaaaucacaaaagagauacuacaacugagaaacagagaaaaauacuauguagcaaaaaggaaaagcagcaaguggcuccagccaagugguggugauaagggauaucucauccauaagguaaaacagaugggacugacuaaaacaaugcaauagucuugaucacagaacaagcaagaguacucacaaagaauuaauuggagguuucgucaugacacugacuuauucuaagucagcacuggaaagggaaaaauccaguuuauaacuguauucuggagaacuagucaggugucaugaaaagggaucuacauuuguuugaaaacaaacaaucuuggggguugaaaaacaugaaacaauuacaaauaaggaaaaggggugaagucuugccauagucuaugggugggaagaaagcugagucagguagauauggaguagagacuugauugacugagaaacucaagcaaaguagacaaggcuugaagggcacugugucaauuaaccagcccuucuguggcaaggaucaaacccuacaauguggaggauaaagugucaagccuacaaaauuggcucugucugucaugaggguugcugccuacaguacuugacaacucugaagguaagguccaguggagaaauugauuccagcugucugauaccccuugcaauguggugacgacaggcaggaucuaaaaguauagagaccaguucucuagaacaaacagugcuuuuuugacuucccucauuuaaagcauacuugggagacacccuguggcuugaaaguagccaacuaagacagaaaagcuggaaagucccugaaggaaauaaugaaugagugaaugaaugaauacauaaauaaauaggugaaaauuuaaaaaauaaauguaaaaaucccuagguccuguacagcaaaguucagcuagcaaagacacugguauucaaaaacacugacaaucucaaaccgaagauaguuuucuaugacaucugagcuuugacugguuccaaaucagcaccagccucaauaacaggacuggaauauuaggggaugcagaauaaauuacuccaauacacuuccuuuuacuuguuauuguuuuagacuuuauuuuuuguaagacuauuauuuacuuacuauucuauuuauuuguuugcuuucuauuuuguuugcuuucuuuacuuauugaccauuuguuccauucccauuauucuuaguauucuacuucuuuucauuuaaacuugcuucccuuuucuuuuccugccccuuuccccuuuuuuuuuuccuuaagcugcuauuucuaauuugacccuaaacaaguuuugacuacuuacauuauucuaaacauauuuuuaauuaucaauggugcuauaaaugcuggcaucaaucaauucaaagucuauaucugaaaauuguuugguuuuauuguauguguuggagguuucuuuccuccuuugaguaguguuaaggauugaaaacucaacagaaggcuaauuacaaauaaaacuggaaaacauauccauacugacaaguguacaaauuagaacacaaaaacaaacaaaacauuauaaauggaacaaaguuauuucagaagaucagcauuuaauaaccaauaaaaagauggccaacuguuugaaaugcuguucaaagaauucugaaguacaugucaaugagaaguuuagcaaagaaauugagacuggugcugggagggaggaugauggaaauaaauaaaauaauuaaaaaucucaguggaaaccauaaauaauagaccaaaucaaguacaagacagaacagcaggaauugaagaaaaaucuguauucagacacacaacaacacaauaaguaaacacaaccaaaccuuuuagaacaugaucaaaaugaaacuaaagaauacauggagcagaaggaacuuaaaagcacugagacuaagucaaugaaauaacagcagaaauuuucuaaaauaucgagaaagaaaugaacaucuauacagaaagauguguaaaacccaaauaaaucauggacagaaagaauugcuccugagcacaguguagcucaaauccuaacacuacaaagaaaauaaaaguaucaacauacuaacaaagguaaauucacuguaacauccaaccucucacuagaaauuuuuaaagacaaaaaucuuuucaaugauuacuauauccaaaguuaucuuuuaaauguaauauaaaaacuuuccaagguaggcauaacauaaggccacuugugaccacuaaacuacaguauacacuuaaaggaaacuuacacauagcagaaugauacaaacagaggagcucaaggaaaaugaauuuuguaauucuauauaugaaaaauuaagaaagaagcaacugugucuacauaaguuaaugaaagaaaaacagaacaaugaaagaaacaacaaaauauaaauguuuuuagcguuccauuuaugagacagauuagccaaaugaauuaaaagcaggaucaaauuauuuguugucuauaagaaauguauuucacuugaacagaagcuaaaggaaaaaaaaaaggagacugaaaagugaguggaaaucaaaaaagaacuggacuacugacauaaguauaugacuguauacuauaaaagaaaacaacugggcuggagagauagcucagcgguuaaaagcaccuacugcucuuccaaaggucccgaguucaaauuccagcaaccacaggguggcucacaaccaucuguaaugagaucugacacucucuucuggugugucugaugacagcuacaguguacuuacauauaauaauaaauaaaucucuuuaaaaauauauuaaaaauguaauugaggaaaauaccuaaaaaaauauuuuaaaaaauauuuaaaaaaagaaaacaaccaaugagggauguacaauuaauuauaaguauauaugcauuaaaugaugguguacccaaguucauaaaaacaagcacuaccagacuacuguaaaauccaaccucucgggcuggugagauggcucaguggguaagagcacccgacugcucuuccgaaggucccgaguucaaaucccagcaaccacaugguggcucacaaccaucuguaacaagaucugacgcccucuucuggucugucugaagacagcugcaguguacuuacauauaauaaauaaauaaaucuuaaaaaaaaauccaaccucucaccagaaaguacaauauccauauagaaaguaacaagucaaaauacaguaaaauacaguaauaaucuuaacuuuccaaauuaauaacuuaucugauggaaagaaggaaggaaggaaggaaggaaggaaggaaggaaggaagauugauuuuaucuaaacuguaccaaacaucaaauggacuuauuucaagacaucuaaaaaacaucucaccuucugcagaauaaaccuuggcagcccauggaacucucuaagagauaaaccacauuuuugaacauuaggcaagucaacaauaguaaaaauuacuuucuuguacuuaacaaauaauaagagaauaaaauuaaaaugcaaaaaaaaaacuagguaugcuacaaauaccugaagacaauauaauacaaucuuaaguaucauaagaguaacugaaggaaucagaacagaaguguuuuaaaggaauaagucaaaugaaaagaaaacacacuaggaaacagcaaaaucauccucagugaaguaacucagacucagacagauaaauaugguauguauucacuuauaaaaaaaaaggauauuagcaguuaaguaaauaauaaccaagguacaaucuauagagccagagagguuagguaaagaggggggauccaguagggauacaaggaucucccuagaagagugaaauagauuauacagccaacugggaguagauagggagaguaagcagguguggggaggugagcagguggagggagagaugggguugagggaaagugugguagaaacagcuggaauuggggaggaaagaauuuccauguugguguagaaaccuagugcauuggaaauguccuugaauguaugaaagugacccuaauaaaauggucuaguaauggaagauauagaaucuuaaguggccaucucuugucuccagacaaccaaagugaguugcacuucaguuaagugaagagggucccauagaaauucccaaacagggcuggaaagauggcucagcaguuaagaccacugacugcucuuccagagguccuaagcucaauccccagcaaccauaugguggcucacaaccaucuguaauaggauccaaugcccucuucuggugugucugaagacagcaacaguguacccacuuauaugaaauaaauaaaucuuagaagaaggaggaggaggaggaggaagagggagaaaagagaagaggaggaggaggaggaggaggaggaggaggaggaggaggaggaggaggaggaggaggagaagaagaagaagaagaagaagaagaagaagaagaagaagaagaagaagaagaagaagaagaagaagaagacgacaagaaagaaagaaagaaagaaagaaagaaagaaagaaagaaagaaagaaagaaagaaagaaagaaagaauaauccccaaacagccuaagcuguugucaaaacaacagguugcuaccugaaaacuaacaguagagcccuacugcuaaggacaauauccacacuacccaaugaacacggagaagccaagcugcugccugcauggacucuucaccccuacacucuacuucuuugguguaggaagguacucuacaagcuaccaaaagagauauacgcacaccaacccagccacaaaaccuuugaccuacaaucuguccuuccuguaaaauaugcuaaggcaguaggggcaaagaacuagugggaguagccaaccaaugucugauuugacuuaaggcccacuccaugagaagaagccuauauccagacugcuuggauaacuaagaaccagaaaccuaggguaaaacaaaaacacuacuuacguuuuaaauuuuuuuuuuaaaucuuaaaaaauuuuaaagucaauaaaaugauuaugguauacacauuguaucagugccuaaucuaguuacugucaaaagagguuuucucuggcagcagauggaaacaggugcagagauggagagaccacagucagacauuacauggacagaauauuuaaaugggagcucucaaucaaauacuuuacagcagagagcagggaagcccuuggaagagaagguggaaaaacuuuaagagccagaggggauggacgauaccagaacaagacccucuaaaucaacuacgaaagucucauaggaaaugucauaaacugaagcagugggucuguaccagguauguaugucuguauguaugucuguauguauuuguaagugucuguguguauuauauauguauguauguaugcauguauauguaugcauauacauacauacauguacuacauguauuacauauauuacguguauuacauauauauguaguauauuuauacuacaaauauguauauacauauaauacacacacacauaggcacacacgcaugugcacacaaacacacauguaaaauagcuauagguuuaguauuguaugguacucccuggugugagaacgaauuaggcuucugacucuuaugccugcucuugugacucuuuuccucuuguuuaccaaggcagacuaccaugauaguuuuugcuucaucuuauuguauuuuauuuugucauguuaaaaaaaaaaucaagaaaggaaaauauauuaugauacagaaaggcaucucuaacagugaaguuucacuccuuccuuuagaaaauucggucagaauucaaauaaaaacuuaacaaugcacaucacaaucucagaaaaauaagaacaacccaaacuacaaacuaauaccuggaaaaaaaaaagaauaaagaccaguauagaaauuaauguacugaacucuaaaacacagaguucuuucuuugaagagaauaacaauuccuuagcccaaauaaccaaagaaaggcaagaccaaauuaauaaaauucaagguuaagaugaggacaaaauaaaauguaguacugaaaacacaugaggucuuuaguaauuaauaugaaaagcaacauuuaaaaagaaugaaguaucuagaagaaaguuauaaauuccucaacagguaugaucuauaaaaauuauauuaaaaggaaauuaaaaaaaacuaaagauacagaaagcaacaaaacugaagcaguacauccuaccaauaaagaaaagcaaagaauagauucauugcuaaaauuaccaguucuuuauagaagaacaaacggcaaaaaaccucaaaguguucuaccaaacagggaaugaaaacuacuaaagccauucuacaaaaauauuauuuugagaguuccaaaccagguaagagcacuuagaaaagaacacaccucaaacauacuaaaaggcuauaaaauaaccugagacuauuguuauguuaaauaaaaaaaaauacugaagucauuuuucucuaauaucagacaugugacaaggguguucaguuucuauaauauuauucaauguagcacucugaagucauagagaaaacaagaaaaaccagaacaaaacaaaugggaaagaaaagaacaaauuaucucuguaaguacacaaaagcauucuuuacuuaaggacucugauaaacacuuguagcaaaaagaaagacauaaccagggcuuuucuauauaacccuacaaagaucccaagaaacccagagagacagagugacagagacagacacacacagagagagagagagagagagagagagagagagagagagagagagagagagagagagagagaaaugaauauagcaaaaacugacaaaugagacugcaacaguuaaaaggcaaaucaguagugaagagacaaccaaaauaauggaagaaaaucuuuaaugcagaaaacuauacaucuaacagaauuaguaucuagaaugucuaagaacaaaaaggcacgugccaaauaaacugauauuccaauccugcacuaaauuagcccucuuccucaacauuguaaaacucuucugugauaaaaauagaacaauccaacccaagggcauauguacuggagaucugcuuuagccccacaucugaggugggacggcaugggguagggagagaugccuucuucuaccccccucucacuaccuacagcagguagaacuggcccuuucccuuacugauugaaucacucaggagcacagguccugcaaauugacuauaacagcucagaaaagcuggcuauggugauguugcagguaagcuggaugcaaggacauugagagcacaagggcugauccugcuucauuggguaaguuaagcaggauagugcuugagaguugaccucggcugagaaaaauaacucaacuaccucccaagcacagacccagggccuaccccaacaucuacuccaauuaugaucugcuggaacuuaugaaguugccaguucugcacauccaaaacugcaggaucuccaugacacaggguaacaacaggauauccaggaguccugguugaggauccaauacggcagaaccuagaggccucaaaauagaccaauaacucauugcaaugaacauuugcaaguagagauguguggacaaaagccuagaaaaacacaauacaaaaggccaguaaauaaauucuucccaacauauuauaguuaaaaaauaaauaaauaaaacacagacuaaaggauacuaaaggauacaagaaaaaagugacaucacucauaaagcaggcucaucaaaauuaauaucuauucaacaaaagucuuuaaagcaugaagugucuggaucagugauccuuaaccuuccuagugcugugacccuuuaauacaguuccucauguugugaugacucccaaccaaaagauuauuucauugguacuucguaacuauugcuacuauaaucaaucauaauguaaauaucugauaugcgggauaucugauacgcaaccccuguggcaguuaugacucucaggcugaaaacagcuagccuggauccugaaagaucacaacugguaacacaaagcauuacacuuguaaaacuuuacacaaaaauucaaagacaaauagaaauuuuccaugauaaacagaaaaaacacacaucuuucaagaacucugauuguaaauggucuuaauuaaucccuucuccaaagauacaaaauaaagaaaauuagaggaaaaaucuaccagguggauguuacaauuuuagacacauaagcaacacagaggcgcacaauuucauaggaggaaugcuauuagaucuaaaaccacgugucagucucaacagugacugauagugggugacuucgcuacccaacucucuccagcagacagaucaucuggacaaaaauuaaaacagaaacucuggaguuaagucaaaugaauguaauagauauuuguacaacauuccacccauauacuaauacauucuucucagucuauggaauuuucuacaaaaaucaacuaccuaucaagacacugaaaaagucauaauauaugaauacuguaauaccauacuucuuuguauagaauacaauggaauaaaauuagauauuaacagcaaaagauauuacagaaaccaugggaacuaaauaacacauuacugaacaggugaucucugugagcucaaagccuuccuggucuacagagcuaguucaaggagagucagggcuacacagagacaauuaucuccucuagaaacuaacacccacaguuuauucaucucugagaaaagcaucauaaaugaugcacaagaaaauaucuucaaacagcaaaucccuguuaaaggaacucaaagacaauauaaacaaauggcugaaugagaacugcagaaacauguaggugaaucaaguaacacaauccugagaaccuuaggacacagaggauaucucaacauaauaaaggaaaaacagaagaaauuccuggcaaacauguuaaauaacaaaugaaaaaaaaaaaaaaacccucagagcauccuuacuaaaauuaggaacaaaacaagcacauucugggccugugcuuguuauuucagguuaauauaaugcuugaagugcugaugagagaaauacuguaagugaaggaacuaaagaaaucaccagucaggaaagaagucaaauuaucuuuauuuacaauaaaaugguucuauuaaaaaaaaauccuguaaguagcaaacuguaagaaucuaccagaaaacuccuacaguugauaaacacucagcaaaguaacaauacaaaaugaagacacaaaacucaguagucuuucuuuguacaaauaauaaacaaaaagacaaagaaauuagggaaaccaucccagucacaauaaccucaaaaauuauuugaauaaaucaaacuaaggaaguacaagaguuguauaauuaaauuuuaaaaaauuaaagaaaauauguugaaaaagcaaccagaaggugaaaaaaaaccacccaugcucagaauguuguaaaaauagucauucuaccuaaaacaauuuacagacucaauauaauccccaucaaaaucauagcuugauuuuucauaaaaagaaacacuaaaauuuauuucauaauacacaugacagaaaaacaauccugaauaguaaaagaagugcuaucaguaucaucaucuaugauuuuaaguuauacuacaaagcuuuaguaauaaaaacagcauggugcugacauaaaaacagacacuucaaguaaugaaaucgaagugaaaacuucuugaugguaagaucagauugcuauagacaccaaccacauccuugaaucacagagcauggagacauuaugcugguacucacuggaaaacuuuaucacaacuggcuauaauccacugugcuggcaagugcuauauaaacucucuugagaauaaaggccucaaucucauccaguuaugaacccugaaggcuaaaaguggccugacaagauaggauuacuaauaauugcauagguguuuuaggaguaacuagccacuauaugauugcauuaaaggucuacucuauaaaguggaggccauacuauuaaaggagccaagaacuugugaauagauaagguaauaggcccuaggguagaacccauaccauuacucugcuaaaugcacauaauauuaaaaugacuccuaaugauuauugcuauaucccgagaaaagcccauuauuuuagcuuucacuagagaagcuuugcuccguaacauauggcaaguaacagagaugauccuauuccaaaacugguaagcauggcaagaaaaagaaaguguuaagugcucaaucccaaaucagacauuuaucucaccccaaagagcuggaaagauggucacucacaggugguaaauaacuucaaggaaacagucuuuuccaagagcaagagacuagaugcauauaugaacuuaugacaagucauuacgauaauacacccaagcuacagccagccaaaaccccagcauggggggguggggguagagaugucauccuaccacaagugucuuaugaaccccugguaaucugacuacacacuacagcaggucccaauuccaagacuagccugacaaugcaaaacuagacucaauggagaauaaaggaaaaaaaguuugaaaaaguauaaucuuaaaauaauggaaggguugagagggcuguaagaggaggaguugaggaagugauuauauucauuuagagacuagaugaaauuuucaaauuuuuuuaaaggaaaaaagaauuuuguaaaaaaaaaaaaaaauuaaacuucaaccucuugaauuguugaccagugacaucccagugaucacucucuuccaaugcuggcuauuuauuuccauaguuuuugguuacucuccagaacuugacaguaagacacuacuacugaagauauaacacacuucaguaaagaaauggaaaaauuaagcaaaaacucaccuugaagcuugaucucuacuaacuaggaucuguacaacuugacaaugcuaugcaaacuaucugacgagaaaaguaaucaggagauauucaacuuauaaccaaccaaugguccuuaguuauaucacaguucauucccaaaguuuccauaucauuucugugguccaauagcaaucacugacuccacuauuccacacuaacuauauauagugaaagcaugacccaauaacuaauccuuguaucuuccaaaauaccaaauuacagacucaauaaucucuaauuucucuuuuguuauugcuuacuuuuuuuaguugguauuccucuaguuauuugacuuugaugaaaaacuucucagauuucuucuccauauuagaaggcuaaucuuagguuaaagaaccuucaaagguucaaucugaccaagaguaugcucaaaaaacccagaaaaauuuuugaaaauagaaccaccuauaauuagaguucaguuucacacagaaacuuaaaagcauccgaucuuauaaccagaagucacccugauaaaaauguucagcucucauaaaaaauucugaaaaaacauucaaggaucaacaaggcaaagugauuugucaaauggcauauucuuaagauguuauguauuaucccucauaaucacaggcugagaauauguaauaguuauuuagaaauaaacugcuaccacaauauauuucugagacacuaaauauuuuucauacauuuaaugauuuuucacuaacacuuaguaagcaagcauuaacucauuaacuaacuauuccuuauauauuuugcuacguauucaagguagcuuuaguugugaauuugauagucuaauguguagugugaccuaagggacucucaauugagggacuaccuagauuaaacuggcccaugggugugacugggggaaaggggaaggucuugauugauguaagagggaccaguguacuguggauaauagcauucccuaggcaggugguuuuggacuguaaguaagugguguuagcaaugcuuaggucugaaaauugagucagcaacaguauaaaguuccugcccugacuacuuugaacgauggccuauaacauguaagcugaaauaaacccuuuacuccccuaaguuucuuuuuguuagacuguuaaauauaaacagaacauuagguucccauucuacugagaccuuaaaagaaaugaagugauacuaaaucucagaaaggaaaauaguaagaauugagaagaugggacacaaucauauuuugauagagauacucagaaaagauaccuaugacaggcauuaucuaagaauucugaaacaaguaaaaaagaaaaacacguagauuaacucaagagggaacagucaguaaguuccagaacuaaaaccucaaaaguugcagguuaagaacauaaugcuaguacaggaugucacauaaaugaaagagccaguucagggcuguaucaauuucuaaccauaguuuaagaaauaggaaaccuuugaaaaguugaguauagaaaagauggcuuaacuuuuuuuuaaucagaaaagcccauugaauuguugguaguaaauagagguaggaacaaaaguacugagaaacaaugaugucccuuaucaaaagauggcaaugguacuacaaaugcuuuuuaaagaagcugaaauguauucugaagauaaaugcaacauaacuugcaaacaguuccaauaugugacacaaagagaaacuaaggaugcuuucuagaauuugguuuaaaauaaaguccuacuaaauaagaugcaaaugucuaucagauuucaagggauugauagcauacaaauaacaguucuauuuuggaugaauugauuucuggcuuuuuuggggggugguguauacauguguugugcacacaaacauggaggcaugcaugcccaugcaugugcauuuggagaccagaaagcaaaggcggucauaauuuucuaaugcuccucacacaauuuuuuaagacguggucucucccuaaaccugacacuugcugaauuaucuagacugaaugaacacauuucaaccaccauuccauuucugccccuccaccaaggcugggaugaaaggccuugccucacuuuuuacauagguucugaaauucuaguccacauaguuggaaagcaggacacugagccaacucuuuaggcccugcuuuuagcugcuuuuuguguuuguuuguuuguuuguuuguuuguuuaaagccaugaucucauguaacuuugacuugccuuacuguauaggcgaagcugucccugaauaagcucccaaguaccgggaguacagaaguggagcaagcaaacauacccagccaaauaucaaaauucuuaauacuucuauaugcacaaauucauaauaugaaauuuucauauaauccaccuagauaucuucugguuuucuuucuucuucuauuaaacucaugggcuaaaggacaucaaugucaaugugcauguuauaucccaguauuaagagucuccaaaauuauuuguauuucuuaauaagagaacuuuacaaucucuuuauuuccaaccauaacuccuuuaucuuaagcauaauaaacaccauauguaggauuauuaaaauguuauucgucuguuaaaaacacucacucaugcaauaauaauuuuaauauaugaagacacggcuguuuuuccaaaguuuuuauuuucauugacaaauaagaacuacauauauuaucauaugcaaaagugauacaucaaaugaguuuauaaauucuaacauagcacuuuugcacauauacuuaauaguugacuuuuagugauauucaagaaaauauacagaaagaagucaccaugcucuacaauuuugguccugaacuacauucuauucauuuugcauuuuuuaugucuaucauuuauucuacucuaaguaacaaacaauuuuuagaauguuuuuacagucuauguacaggaagaugaugcacuaccuguuuuugugcugauuuauuucauugaaaauauaaaggaucauuuccauccauguugucaccgacauaagauuucagaaaaaaauuuuaauggcgaaaaauuacaucaucauauaugucaauuuuuauuuguuuagccacugacaaacacugguuuauuucugcauuuuguuuaauuaaugcugcaaucaaaauuaaacugcagguaucucuuauaacacacuauauauuucuauaauacaauugcuaggucauugcaauuuuuaggaaccuguuauuuuccauaaucgaucuaauuuacauuccaaacaacuguguacaagauuucuguuugcuuacaaccucaccaacaugaacauucauauauucuagcagguaggaaguaguaucucacuguuguuucauuucuuagaugauuagaaagguaaagaauuuuuuuucucaugaauuugaugcuggucauggugguacaacaccuuuaaucucacacucagaaagcagaaacaggagaauaucugaguuugaagucagccuugucuacagagcaaguuccaggacacucaggcuacacagagaaaaacuugucucaaaaaacaaaaauaaauaaauagguuuuuccucaacacagaaaaagagcaagaauugaaauauuugagauucugcaaagaauagaggaaaagaaaaaauauuauaauaucaaaauaauuuuuaaaaacucauuuaaccacuuugccauuuguacuccuuuuuuccccugucuggucuauaccaccuuacuugucauccucuggacuguaguccaguuccacauucuuucaccagcauagagcuuaccaaucagauuagccccauggauccuccuggaucuuccuccccagcaccggaauuuuauguguacacuaccacacacugcauuuuuauguuguuaugaaaguuaucaaaucagguccuuaugcuucuuaggcaagcauuuuaccuacugagcuaucuuccuaccggaacuacuuguucagaagcaccuauuuagguccccuauccacuucuuccaugagcugucugaauuacacauuucauaaaguaacuauucagcaugugaaugcuuucauucauuccauagggggguuaucuguuaacuauaucuuuucuuguguagaaagcuauuguuuuguauaaccccauuagucuauuuuuuguaguuauguuuuuaaaacaaaauuuacaaacacuaauuaaaaagcuuuuccuguuuuaauauauuaggugauacuuaaaagaggauauuaacuaaggacacaacuuuguccuauuuaacauacugguuuuuuuauucugcaagaguggucagugcuccuaauagcugagccaccuugcagccucaagaaugcuugagucagagaguaaggcaauauggccccuguaguuaggcagacuuggguuuugauuuuagcugauguuguuucuuuuggggauuucaagacaguguuucuugauguagcuuuggguguccuagaacuuccuccugacugucucugccucccaagggauuaaagauuaaaggcaugcaacaccaccauacugggcuaaaauaaauuccacuuaauuauaaugaauaauaauuauguauuguuuaauucaguugguuauuccuuucugaagaacuuuuguuacuagccuauaguacuagacuuuuguuuucauaugagaguaaugacuuaacuuauaguauuaguucuucaagguuuagugaauuucaucagugauaucauuagguucugggcuuuaugugacaaaagacuuaauuccugauuuuuccaucuucugaugacacaacauucucaacucuggccaucaauaauagcaugcaaacuuaaaaugcucuaaugcuaaaaguguuauacaugaaacacuacuaaugguuuguccuaucuauucugcuaauauucaaucuaaaauauuaucuauuagagacuacugguacagucuaacugcaagcacuaugagguuucuaaacuaagcaggccauucagugcaugaaacuuucaacauuuggucuguuuuuuuaaaacccuucauaucuugguaaguuuucaguacacucaaucucaacucaauuauaacuauaguguuccacaaaacaucauuaaaccuuuuucaaaagaaaaagaaaaagaaaaagaaaaaggaaaagaaaaagaaaaaaaaaguacauggggagcaaagaugugguggcacacacuuuaaucucagcgcuuaggaggcaggggcaggccagucucugaguuugaggccaaauuggucuacagagccaguuucaggacagccaggguuaaacagagaaacccuaucucgauggggagggggaaaaaagguacauggggaaggcaguucuuuaguuucuacuauaccugcagcuaucuagguauacaaaauaaacgaguuuucuuuuaaacaacaacaacaacaacaaaaguuauuuggcuacuaaacuacaauaaaauauaaccucacauccauuaggaugacuauuguuccccaaagaaauuuuaauauacgggucaaguuguaaaaaaaaaauguauaaaacuuuuauucuaagaaauguaaguaaaaugguauagcuauuguuuaaaacagcaugauauauucucaaaauauuaaaaauacaauuaccaugauauucuauaggaccaaaagaauuugacaaaagauuagacccaugcuaaucacaacauuauucacaauugcuaaagcacagaauuaacccauuaacaaaugagcagaauauagcauauacaagcaagcaaguguuauucagccaaaaaaaaaaaaaaaaaaggaggaaguucuaguauaugcuacacauaaacuucaagaacacuguguuauauaaaauaagccagucaucaaaacaaaacaaaaacugugugacuacacuuacuugagauaguuagaagcaccaaacccacagacaaaaaguagaauuuaauugccagccacaguggaagaaacaggucacuauuuaaugcauacaaaguuucaguagggcaaaaugcaaacaguucugaugacaaaugcucaaacauauuaauauuuacaauaccacuggcucauauacuuuagaacaauaaagaguaaauuuuauacauuuuauaaguguuuuaaaguuaucagagaaguuacauggucucaaaaauuuaaaggauaauucauaguuguuucuuaagacuucacaauguacuuaagcauuuaaagggauguaaucugcuucuaguaaggaaaaccuggacuuuuucaaccacaccuuaaacauagcuauacacaucuaucuuuacuuccuccucauuucuuaagacaggaaugcauaugugugugcauuaacauagaugguauagguagauuuauacauguagagagguguguuuagaagucagaggcuuguuuucacuauacucaaagcuugucaauuaugcuaaccuagcagccagcuugccucuuacuccagucuucuuaauacuuacauagcaagugcuauauucaccaagucuuugccacaguccccugcuuaauuccuucuaguuauuccuauuuucauuuuucauuccucauugucaaauuuugaaaagguucucaauuuccuacuuuucccuacacucaagugucuugcuucagaaccuuggcaaugacuuggccuagaacacuguucaaauauccaacugcuuaauccccaguaacauuucaggauucaaccuaguuuuacucagcuauaccaauguuccuacuaugcacuagauuucuuuugcauaauuugguacuccucuguauucccacuguauaccaaguauaauucuaucucaauaauuaaaaaaucugauucugcucuuucugaagcauugagauauaagucucaagcaucuuuauacccaaaacauagcaccugaugauuaauauuuagaacaggggucauauuuaaacaaucuugcuuucaggaauuauaaauuaauagcaggcacauagauguuugaaucuuccucuaauuccccuauuuaucaacaacugccaagggcacaaaaaacauugaaaauucagaaucauguauguaauuaucuacuuaccauuagacaucuaauuuuuugcagagguuuggaaguauuugguuaggagauauaaguagacauguuccaaucucuagauacaauuuaaaguuguuccuucuuuuucuuuuuuuaauucaauuuuaccuuuuuuuauuuuaagccugaaagguauuuucaaauaaaauaguguagggcaacuugagacacaaaauaaccugaacgaaguuauacuuacauucggcuagcuucaauguccucagacugggauucuccuggugaucuguaaaauguaauuaaagacaaauauuagugauuuccaaaaaaaagguauagaaauauaaguaaggaagauaaacuggaaaacaagacuuaaauuccaaugaaagggugcuuuaaaagauuuaaaacuaagaaaaaaaaaguagaaagaucagauuaucacaacacauuuaagaacaaauuuuagaaaccucaauguuuaaaaagaaaauuaaaaucuuuauauuuagauaucaaauuaguauaagccauaauuauuuacaaugucaaacacauauuaaaaaacaagacuguuacuuucuauuaaguuggguugugguauucauagucuugaaauuaaaugaaguguuugcaaacuguaaccugagcaaacacuaagguguaggauaaucaccuuuauuuugaagugauauuauacugagagauuuguauucauuuauacacugucuauguauucagaaaaagcaaggauaaguacuugcagaaaaaacuauuuccuucaaaaccuaaaacauuauaaaaaaaaaaaaucccuugaaaaaugucugccaauuucugcaguagacaauuuaaacucaaauauaacaguguucauagaucuuuaagauauuuaaaugcuaugcaccauucuaaucauaauuccugugguucuauaaggaaauuagauuucccuaaaaagcacuaucugccgucaccguguauauggagcauuauguuugcuagauaauuguaggcuaguuuuaguuuuaauaucugcugguuauuuucuuuauuuuuuaauauauuagcuaauauagaaauacauauaaagcaccaaagaguaucccauuuuuauuggguggaacauaagccaauuucccuauucugaacaucugguuaaagaacaaauuccagugaugcacacagcaauacuuugcuauacuuccugucaucagaaugcuaaaccaggauuuagcaugaggacaggcuguucuacauagugagacacugccucccaaaaagaaaaaaaucuguuacccuacauaucuuuacugugagacaaucaauguucuaagguaaauuuauuuuaauaccuauuucuaaugcuuuaaauucccaaaauagguuaagaaagaaaagaauaauuuaaauuuucaaauuuguauacaaagacaaucugugaauuuacuacugacuuuagucuuucaaguuaaagacuugauuuguaaauuuaucacugacuucagauauucaacuuaaacaaaaaguuuauaaaaggcugguuguggcuuaugguuauggaagauuuuuuaaagcaaugauucuuaaguuaggggauaaagaagaggcucacuaguuaagagcacuuacugcucccagagaaaucaagguuugccucuuagcacccacacagcugcucacaaccaucacaaacuccaguuccagcacugaugcccucuucuggccuaugugaguaucaggugcacaugugcaucugguacacacauacauaccugcaaguaaaacucacacacagaaaauuuaaaaaucuuagccaggcaaugguggcgcacgccuuuaauccuagaaguuggagggcagaggcauuggauuucugaguuugaagccagucuggucuacagagugaguuccaggacuacacagagagaaaucccugucuuaaaaaaacaaaaaacaacaacaaaaaaucuuaaaaauuaauguauucacuucuuuagugucaaagaaauuucacuucuuugcuugacuuucaaaauaauacucauuguaauucauuuagauuccaagucaguaacacacacacaaagaaaaaggaaaaaagauacgauuaaaaacagaccccaaaagcucagacaguuuagauuuucuuaguaguuuauuuauauuuuucuguuuaucacaaaauuacauaagaauugaaaaauguagauuaggagugauaucaaauaaaaaauucuccacccucuucccccagaaaacaagcaaauaucucagaaauaaugaucucuacagccuuaagaaacuaccaagauuguuuccaaacuuauaucucauauaaaauggcuagaagaguuaaaacaugaugguaacccaugcacuagcuaacucauuuuggaaugugucuuuccaacaucucauauauuauuaagacugugagauaaagcugacuugcaaaacaacaacaaaaaccuguuagcaauuaggaagccaaauuagaagucucuaaacagguaggaagcaaaguguucuaaauguacaggaaaagaaaaauuuagagaagguuaagaaugaugagagaaaaaauauuauauaagaaaauauaagauaagagaaaaaaagaacuauaucucaagagaauauuauagaacugcugcaguuucaagacccuaaaaugaacuauagaacaaacauauugucaaauggccaacuacagcuauuuucgcaauuucugauugcuacagaguaugugaaugccaguaacauaaugccaaccaaguauuguaaauauacuagacuucuauuuaauauucacaaauauuagaguaaguuauuaagcaccauuuagccaaacuaaaauuuaagaaaccccagaaagaucagaguaaaauuaauccaaacaaauuauucuucuuaaauuauacucuucuugaucucuuagacauaguauagcagaggcugcucccauucaaacaguuuuacuuuagucaagagaaaaauauauaaauacaacaaaagcauguuucugaucauuguguacaucugaaugucuaugcagacaauuuuaauaauauucuaauuaaguugccaaaauauauccuaaaacuagaguuaacuuucaaaguaacucuauuuuuauaacuauuaguagguguuacaaaccacaaaguauauguaacaccuacuaauaguuauaaaacuguucucugcucuuaaaaugcuugcugcuuuuuacugacaauacauuugaaauaagaauucaggacaugcuccuaauuuuaccaaauucaaaauauagaaccaacuaaaaguuaauaaaaaauccacuaccaacccaagacugacccaaguuauccuaaaguuuaccagaauauuaauaaaggaaugaaugaaauuugaaaccugaaaaauaccuaguaacaauggugaggaaaaagucuuuuaaaaguaucaauuuuagguauuaacuuuaaagacagaaaauguaaucacaaaacaaauaaucugaacacuggaacaugaccuaguaaauccauccuuuuaaggagguaaaggugcacuuuuaacuccacuguaacucucuaggagaaaaaguacacucauuuuacuaaaggugcaacauuucuggagaagcacugaaacuccugccacauaaaauauuaaaaauaauacuuaagauauuuuccacauaucucuuaaaauguccacacuguaaucuucaaaauacuuaagacauauuuucuuauuaaucuaugcagaaaaacaggucuuugaugauuacuuaucuucaugaacugaaggguaaguaagaaaugcacuauaauaaauaucugagaaaggagguuaaaugaagaaauggcuccguucuuaggucuuuuauucuuagcaauauuccugcuaccuaugcauuuuugucauuuuuauagcacauaauucaucuuacaaugacagccuuucuaagacuguaaaauaacauucaaaauuaccuuuuacaagcuguggccauucggugacaucagggugauaacagcuuugagucacugauuaaaaacagguugucacaccagucuagcugcuaacuugaucugaacguaggcuuaauaauucuaauaaauuaaacaaaccuuuaguuagaacacuagcauaaacccaauucauuguucaagucauuaucuucaaagcuuuaaaucaguagucaauauaaaauuagaagaauaauuaucacaggaaaaccuuuaugaacuauucuucaguauauuguuuucuuaaauggucucuucauuugagaaaaugagguauauucucaauccaaaacuacuccaaaauccagaauguuuuaaaucaucauggcagcaaauaaaaaagggcuggauuuaggaauauuuccgauuuugaauuuucagacuagguauguucaaacaguaaagucuauaggaacaugccaaaaucugaaaaauucuuaaauuugaaacauagucuggucccaggcauuucugauaaagauaauaaucccuacuuuucaauguaguacuauauggcucacaaaauacaacaaucaacuguacccuuacauuccacugacuuuagcucuacaagaucaaaauagaagaauaacaauaagcagccucagagugauuaacugacuugccgaagauuuuguaaauaauguugaaauuaagaccaaaaaaccaauaucagcuaaauuuccacuaaguauuagaauuuugcuaugguuuaguuuugcuuuacaguguuuuguaauuuaaauacauacaaaaagcaaaaauuuagacuauguauuguggcaguaauuagaaugaaacugauuuaguaucaagagucuuuaacugaugggagaaaucagcuaccaaacaggcaaaaucuugauuaaaguuuuacacacacacacacacacacacacacacacacacacacgcacccacacaugaaagagagagagagagagagagacagagacagagagacagaaauuauuuaaguaguauaaucuaucauuaacuuuuagaccuuuggaucuauaagaaagcauucguuuucaaucccacuaagacucaauucuaggaaguaauauaaagcaaaauaugaaugaauauccuauuauucacauaucugaacuaucauaugugauuuuaaacaaaucugauucguuucacagcccuccuuaucauacuauacuccugacaaaaugccaauacuguuaugguuuuauccaguuuucccccaaaauccucuuucacugaucuauaaacauagaacaaauuugaaugagcuuaaaacaaaacaaaacaaaacaagaaagaaagaaagaaagaaagaaagaaagaaagaaagaaagaagaaaagggaguguaagauuaggaagaggaagccccuucacaauuaacacccucaaauugacagcacagacaagccagauggcugaaagcacggaaucagaacccaacuuaaaacaggaaguagugagaaucccaaaggaauuauuaaagcaucaauauuugaacccauauuauuguuagaguuggcucaaguuuauauuauauauauauauauauauauauauauauauauauauauauauauauauauaaacaaaaucagggggucccaauaaauaggauuuauaaccccuguuaagaaauaacccaauuucccaaauuucccuaucauaacuauuuaucuucuacuaagaacagaggcaucacugaacuagcaagggagagaaauaacauccuugaaauaaaugugguccauggcauaguucccuuaguuucucaucaaacagcuuauguggaauuaugugaauacugaaaugaaucuaacuucuaacuuacaaacacaaagauaacacagcuuaaauaaaaucaacuaauucauuaaagaacuauauauacucuuaggauuacuaaaucaaguacucuccacuagucuccucuuuauuagguucaauguucaguugaacaguuuccaaagacauucuaagauuccacucuccaugaucacuuacuauagggaaaucuuggacaaguuacauaaccucucuaaaccucaauuaucuuaaagcagaauuaaaacccuagucuggguuaucauaagagugccuuauauaaaauauguuugcaaauaaaugaaagagauuuuucauacccacagccuaacagccaagucuauuuccuugaccuucuuguucauauuacuuugucucauaauacaguaaacucacaaauucuuccaacaccccacuuauaucccucacagucuaccugguuguauacucagcaccuaguaagagucuuuaaaauugacaggcgcccaaauuuauugaacgcauuugucauuauacuagccguaauauuaaaauaauucaugcaauaugaauuucaaaaaauaaaacagaaacauaccauauuucgccaaacuucugaggagcuggugaacucuaaaaucaggcucuuagagagauuuuuuaaccuaaaauauaaaacaccucacucaauucuuuuaacauaaacuggauagucuuucagaaaaaaaauuacucaaauucauuauaaaauaaaagccaauuucucuucaauaauacuuauaaagauccaaaaauauauugaaagacaaauuaccccacuccuauugccaagaaaaguagcaggguagcucuguaggcugugagcugaauauuuuccgacuaggaaagccauguuucccaucuucauguacaaaaaguaaugcuccacaaucccuuuccucaaaccccuucagauaucuacaguaaguccacuuccagguaaucucuauaugaaaaacuucugcuauauaaaaccuagaguagcaaccauggcuaaauccucugaccugucagucucucaagagugcuaaguuguugaauuagagaaaauguauaaaaagaauauagaugcuuuccugacacauaacagggcucuguuacucaacuaagucacuccaugucuaucacaauucuuuacaaauaaacaauaacaauguacuuauuacagagcuuaaaacaagcucuccuaugauuuuaaauuuguguucauaguucauuuauaacuugucuugaauauuuuucagccuuuaauaucuuuuaaucuuauuuugucauaaggagaaaaccuaauccuauggauuaagcaacuacaaaauaaauaaaucugcauauuauuuauagguaaauagguuggcagguaggugagugagaaggaaagaaggaaaggcaaauggaugggcugauaaaugauggauggguggguggauggacagacagauuaauaaauugauagauggacugauauaacacuauggucuccccaaagauaaacuuuaucacauacuaguaaauccuguggcauaacaguaggauucucguuccaaugacucaaaucagaaaaguucaaaucauccugccaaauauaauauauugcucacucacugcuaccaauuccaccucagggaucuccccacaauccaacacuaucccuaauaauucuccaguggccuuuacuugcuuucgguauagcuuaauugcuccaucacaauauguaaaacuauguuuccaaacccugcuaguauacccuuccuuccagacuagacaaaacauugagaguauguccuuaauuuuuauacuaaauguuuuaaaagguuuauagaauaaaacagcacagaaaaaaaaaaaaaaagaaacuuggguagcuauguaaaugcaaggcuaagaaacuucaaucuguuucaaaagacuauccauguccauuuccuuauaaaccagucuaacucaaagucacgccggaaaaauuagcuuuaaaauucuuuuuuguaauauuucaucuuuaaagaaagaauccauugcuucuuuuccccacaugguuacuaagauuguugugauacagagucuugucauuuuaccucauuucucucuuacauauuugacagaacuauccuccuagaaauuagaauuuggucauaucccucucauauuaaaaaaaaaucccuaugccuucucaauucuguuaacauaaauuucaaacuuuuuuuuacauauuaacugauguccuugucauauggucacauccaguaauccaaacauuacccauauaugaugacauccugaaauaucaaucucccuugguuauuguacucuaucauauaucagaaaucucuauuucugguccuaauaauuuugcuucucaggauauuccacaagaaauguuuuccugugcucugcaauuuccauccucucuuuaucuauaaaagccuauuuaaaaaacaaacaaaacuauucuucuuaaaacuuuagagcaccccaaaugaacaaugacaguuaaggacugagaaugacaauaacacuaacaaugaaaaaaaucagaaccuucacauauuacuaauaaaaguauuucaaaggaauauaaauauauagccacuuugagaaaaguuuuaaaaugccucuaguuuuaaauaguugccauauuucccagacaacucacaccuagauauauaaucaagagaaugcuauauauuuacaacaaaaguuaaauccauauauauguauguauuauauauuauauaucuauuauauaauauauaauuauuuauguguguguguauacacacacacacacaaaauaccauaacaacccaaaaugaaagcauacagaagcccauauacugaugacuggacagauaaucagcuauuuaaaaaacaaacaaacaaacaaacaaacaaaaaaccaaaaaaaaaaaagaaacaaaaaaaaaaaccuuguagaguuucuuuucuuuuaaauuuuuuucuguaaauuauaaaacacacagaaaauugcuuagcauacagcaggcccuggauuucaaacuccagcacuuaaaaaaaauuaauuaaaaucauuaaauugaagcauguagaaaaaaaucauaaaacucuuaucauuuuaccaaccacucagaauuaaagcaaacacaaaagaugccauuugauaucauuauuuaaaaucuaacuauuccaaguacugguuagagaugcuagaaacaaaaauguucauucacuggugauacaguauauguuggcaaaucaaauuuacauaaaauuugccguaucuaaucaaguuaaggauauauccuauuuucuaacaacuucaucccuuuaauuuucccuaaagaaaaccuuuuacaaaggaaguauaaaaaugaucugcgcaauauaggaagcaauucaaaauauucauaagcagugggauacaauacuauuuaguuauccauauacuauaauaccauaaaagauaugugucaacauacacaucucaaaaacagauaaaacacauaaaauaaaacacauaaaauaaagacacauaaacugauggcaaguauguaugaaacacaucuauaaauucuuaagcaugauaucucacuuauuggcaaaggucauauuuaaguacaaaacagaagauauucaagaacuucaagaaaucucuuacauggauaagaagagaggguauuaggacuuggaggaagagauuaaguuuccaaaacaaaaaucaaaacuggcauuuauauuccaggaugguagguaaguagauuauugauauacuauuaagugcuuuaaauauuuuauaacauguuuuaauaagaaacaaucugaauauacaauuucuaagcuaaaaacaaaacccuaagacuauggagacuuccaugacacaaucuucccaauuuauuaaaaguaugcuaauaagauaaaaauguauggcucuugagauuaucuccaugaguaggauaaagccauauaagccugacacuuuaaaaaaaaaaaaaaaacacucugggauuaaaguuaaaaauugagagaccuuaaucuaccuaacuauccucugaccuccacccgcaucacagcauggcacucuuauguccaaauacacauuauacaacacauaaugauaauaauaguaauaauaauucaaaagauuaagacaaaauauaaaggacuaaaggacuagaagaaauguucccuggguuuaaugccaagaaccccccccaaaaaaaacuauuauuauaacaugauaauuuuaagcgcagaauaggugucuaaauaauuaagcuauuaucucuugaccacuaaaaagacgaauuaguaucaauuuuuaaaagaccuucagaaggucuuuguuaauuguccaggccacuauaguacugcuuaauucuguuuaccuuuaaauucucaagccuagagaauuauguauuaccauacauacauauuucaagagccuacagcagauauccuaacccagaccugaacaaucuagaaaguaguucauucaauccaacauuuacaaauaccugcaucugcagaagggaaaggaaaaggacaaaagggagagaacagugagagaggaaagaacugggagacaugagguuagaaagagagaaaaaagagaagaggaaagauggaaaaagggagaagacaaaggauacagaauacaaaauguguacacaaacauuuacuguucucccagacucuucaguauaggaauagacaucuaauuucaacugguuaaguuaugugcauauaucuguuuuuacguucaccucuucccuguguuucauuuaacucaaaaaaaaaaaaaaaauggaguaagagaaaauuucagaaucaguagaaagaugauccauacaaaguuaaaucagaccaaaacaaucuuucauuuuuaaagugacaugaaacauaauguaccagccaguaauuauacaugauguuaaguacagauaaaagacuaaaauuagcucaguucuccuacuaugcuuuaagagcucuuacuuuaaaauuauauagcccaaucuguagaggaaaguauauuccuccuuuaaguuccuaaacuuguacauaacuucuuauucccaucuccagucuagaauccuguacaauguuauagaaucagugagaaacaguaacagagaggauggagaaugggacagaauuuccaagcggagaaauuucauuucuuugaaacuaaggauuuggauuuucuuaauguauuuucuaucaguaacacaugauacagagucaggucacuucaaaagugaggacaaaaacauauucucuaaugagucuuuaucugaaauaagauuuaucuauuauuauacauacuauacaacagguacucaaaaaacaacauuuuaaguuaccaaacaaaaacacauuuagcaaaggcaaauauuaucuuuauuuuuagcauauuguacgcuuagcaaauauaucuacacaaaggggcauaguaaauagaaaucuuaagggagaaauacuaauaaauugaggcuacucuacuuccccuuaggaugcacuaggcauuauuuuucuuaaaaaagaaaaagaaaaagaaaaagaaaaagaaaagaaaaaaaaagaaagagggacuaugcauuucaucuuuuccuuuccaaaaaaauagcaguaugauucacaucugauacuagguaaagugcugaaaccuauaaugagaagagugguaucaacuaaugaaaacaaggaaugaguuucagaaaagacaagaauucaaggaaauaacaaaauauaaaguuuguucaaacuaaaugguacauuacaugguugguuucuuuuaauuucuucuauauuguucauaucuucuauauuuaacuagagguaucagcauuuauuuuauaucacagauuauaaaacuaaauuaauuauggccaugguuccacaaugguaucucuaagacuacuuuuucauaucagaaaguccauuagaaguuuuaagugaauagccaucucuuuuauucaaaaaagcaaaaaaacaaacaaauaaaaaaaacauagguuuuuguuuuaaaaaaagaaaaauuuuaucacauuaaaacacuguucugucgggcagugguggcccacgccuuuaaucccugcacuugggaagcagaggcaggcggauuucugaguuugaggucucccuggucuacagagugaguuccaggacagccagggcuauacagagaaacccugucucaaaaacaacaacaacaacaaaaacaaaaacaaaaaaaacaaaaaaccaccguucagaaaaguacaacacugacaguaucuucauucaugucauagcuauguaauuugugugccaaacugcuugcuuuaaauguccagaagaacauucugaauugaagauauaugcauuggacaccacacacacacaaaaaaaauugguucacacccauaguccccagcacuggagcaguguaaucagaaggauaaguaggugagguuaucuucaacuacuaagaaauugagaccaguguggacuacaagauauucugucuuuuaaaaaaacauauaaaacaaacaagaacuaaaaagugucucagcacuugggccgaagaccaagaauucaagggcagucugcacuacauguccagauacagucuauccuagguuacauaccaugauuuuuaucaacuacuacuacuccgccgccaccuccgccgccaccaccaccacugccgccacagcuaccaccauccauccacgcacacacccacacacauaccccaucaccauucaaacuagauuucuaaggcuccauaacauauuuuuuucaaaguauuuuuuucaaccuagugauguagcucacugcuagguagcaaggcccuguauucuauccccagcuauguaaaacuaaaauugaaggauuuuuuuuaauaucugauuucugucaaauuaaugagaguugugcuauacugcuuaaaugauguugacagguaagaaagaccaaauucugaaauguacugagcugcugcuaagaguaacaacagauuacacacaagguuauguguaaggaaaauuuuauccugcucauauaaaaaguucaguaccuauauacuacuacuacuacuacucugguuucacucaaauaaggaugccagcuucagcaagauuuacauaggauucuccuucauaagccuaaugcaauuucuucgugaggcuucuccucagauuugcuacaacugaacugcaagaauaagcuuaacuaugguacuauggccccuaaaggcuacccuuucccaucauucuuauaacugauucacuugcaauucauuuaauuaaaaaucaggucaagaagagcaaaugacaaggaauucagcuuugcaaauaacuuaucacuaacaauuucauguuaaauguacauuacuuauuucuagguuuuaccugaagccacagaaguaauaagugcuucagaacuucagugguuuaggaaacaaaacaaccuaagcuuauugaaauaguuaucaaaucugaaacuaauucauauauuguaauugcggcuguaaaggagauauaccccugcaaucccagcucucaaaagagguacauaccagaaagaccaggaggcuuagccauguuaacagaaaacaauauaaccguauuccaucauccuuucuccuacaaauuuccugggcaaguuacuuucuuuauacaguaucuaucaauguucaagaaguaucacauaugagcagcauaauccucuguaacaagaaggcaguaccacuuuaauaugauuaacaaggccuuagaaagauaaauggccugcuccuauuuagcucacucuggcucaagacagaugucaggaaagcagcaacuucugacaacaugaauauugcauucuuuauuccauuucaauaauccuaaguuguuuuguuuccuaaaccacugaaauucugagccauuuacuuauucuguggcuucagguaaaaccuaaaaguaauaaguaauguauauugaaaccucuuucaaaaaucaguauaaaaaauuuuuuucauguauagauaggcccaauacuuauaaucuuuccaaauuacuauucauuaguuuaguuguuauagacaacugaaaucaagaaaguauagguaauauuuugaaauuaaaugaaaacaaaggaaaucugauguguacauuaauaagucacuuuauuaagaaggaauaagugucauguauuucaagccuuucaugguuggaaaaagaaauugagaaaaauaauaauauuucuacuuaauacaauuuauuucacaucuuuuauuuaaaagaauuaaauccugugcuaucuuauaaggauuauauuuuacuaauaguauaaaaauauauaacuccauaaaagugaauugcuaauugcaaaauaaguguagcuauucuuccaaacaaacaucucugacucuuauuauugaaucagaaugguaaucauuguccaaauaaaugaguccuaacaggcugaguagcauacuagacuaaaucuauuucauuuuauauauaccacaugugcauguguacuguaaaaggauauugaugggcugcaaguaagacaugaacacauauaccaaggauacaaaaaaggauacaaacaguauccuuuacaauuguagcuaagggguuaagggauauuaagucuacagaacugcccuaaaacuggaggggcacagacaauuaaauuccauaacuuaacagaauuaucacauuaaaaaauaaaaugguguuaugugcaauaaauaaccaaccuaucaguuuccaaaugauagauauuuucuuuuuuuuuaacccuuauaacccaugucagcucacacaauucaaaggagccucagaaacacuaccugauacugauaacuauuucagacauauucuucuaugugaucugaaucuuugcacccccccaaaaaaaaacuucacuaaaagccuaaaaucggaggugaugaaauuacaaguguaauuuuuaggaggaccuacauugaugaaugagagcaauguccuaauuuuaaaagaccauuuagucuuagcugaagcagguggaucuuugaguuagaggccagcuucgacuauuuaccuagcuucagaggcuagugagagacacugacacaagaaagggaagcggggaggggaaaaagacaaaagaaaaaagaaaggaaggggagggaaauauagggaaggcuggagagaugauucaaaaguuaaauuaaaagcacuuguugcucuuccagaggaccuggguucaauuucuagagcccacauggcaauuaacaacugucuauaucccagucacagcaguuccaacacucucuucucaccccuacagacaccacaccaauguggacucucauauaauaaaaucaaaaaaagaacaaacaaaaacaaacaaacaaaaacccuaauaaacagagacagagauacagagacauagugauacuggccugcaaucacagcuccuauggaaggcggcaggacucccauuucaaggucugagcuggaguguguacagaggacuaggaagugguagagcaguuccuagaacuugagaggcccuagguucaguccuuaguccuccuaacacuacucaaauuuacaaugaaaauuaguucugaucuuaagauuucucaguguccuugacugugagauacauuuuuuggaguuggggggaagggggguguugaccagucuuugguauuuuauaaauaggccaaacagacuuaaggauucuggaaacauagucugaggccagccuggucaauacagcuagcuccaggacagccauggcuacacaaagaaacccugccucccaaaaauauuaauuaauuaauuaauuaaagaaaaaaguuuucaauuacacauucuaugacaucucugauugauaacuuuuuugagacaaggucucgccucuuagucuaggcuugccacaauccuuccuuagccucucaauuguugguuuacagaugugagacaucaugccuaacauaacauugucuuuauuuuuaucaguaagaaaaaguaacugucaaaaccaaaacucuauuauccuaagccuuucugaagagaacaucaaaagacuuagaggacuauuuuuauauuuuuauauuguuuuuccguauuugaaaguacuuaaaagaccaccucuuaaaacucaucuccaguugcaaaaaucagaacacugauguuuuuaauagcugcauauaaauauaauauaaauccauuaacaguaauauuaucaauaauaacaaacaaaccuaauuagaauaaaugauaauauaccaguaaccauucauuuaagguguugguuuuuuuaaaggacauuugaaaagaucaucuuaagcucuugaacagaaaaaaaaauagcuauggccaauuaaaaagaaaauguucauaaaaauugagagaaacaauuauuacugcaauuauuugagggaagacacaaauguuuaagaaauacaacugaauaaaauuuacaugucagagacauuauagauaccuaaugaaugcaauguuaaaaaaaaaaaaaaaaaaacgaaucaaauagaaugaguuuugucucagguagaaaucacauuuuucuaauuuaaaaccauaaaaaggguaaauagccgguccuggugguauacauuuuuaaucgcagaacccuggagacaaagccaagaggagaguuagacgucauccagcgauauaccauaagacccuuucucaaaaaaaaaaaaaaaaaagggugaugguggcuauuucagggauaaaaaagccaccuacaaaaccugcauacaaaaggaauuuucuaaacucaaaguuaagcuccucaguuauaugaagagcaacauccaaagaaguauguguauaccacuucacaacacaccaugcaagguaaauauugacacaaauuauuucacaaccuacauucugauuuugaaaacaaaacuacaagucaucucaucuuuauuaugugcuguaucuuucuuaaacgauagacugcgaauuguugaaguucucauuuuuauuacagauucugauacauggcuuuuuuguaaagcuaaguauuuauggauuuacagucauccuuacuuaggcuuaucagcaauacagaugcaguauccacuuccuuaaaagugcaguaagcagucuauuuaagaggagaauuuaauacuaaagcaauuucugucauacauaacaagacaaaauuuuccuuuuaucucuccucaauucuaaauuuacauaauuuaccaaaaagauaucuuaagaguauuaacuaaucugaggugugucaaaaacauucgucgugucucuuguccaauagggcuuugauauuuagcuuuuuaacagcuguauuucuuaaaguucaggccaucuuuauuucaaacgcacuucccuauccaaaacauuuuaacauaaucugcugcuucucccaaaaccauggguuauacgaauauccuucacgaaguaagauaaugguggauaacacaucccauauacuauuuaguuaacauuuccaacaguacacuagcuauuuaacgcaaucccaaagagauuuuauacuguucuauuuuagcaugcucaaaagacauaaaaaaaauugacguaaaauugucuuuagaggauucuucuaaagcugauaaagucuuauuaaaauuauacuuucuauuuuuaaggcuaacgcaauuauagcacauucaacucugauucuuccaacaaaaagccuccgcaucaaaauggggaaaacguccuuuucauuuucucaacugaaaagggggaggggagaagaggaggaggccaacugcuuacagguuugcauugaaaauuaacacagcaguuucugaggaaucaguaacucacguucaacuacugaauccuaccagaagcagcacacgaauaaaaccagagcgcaauccuugggcuugaggugccgcuucauccgucuuccuuccaauccacccccaauaccccaacccacuaagcacacaucuaaauaugucuuccccaccagagcgccccuuuggaggaaaaggccugccuuucgcagccugaagccacggcuggcucuccgaucucugcuuagaugaggcccccgaucucgacgcccugcacguccgccccaccccgggcccacucggguacccgugggugacaaaacccucccuccugcguccagccagcacugacaguuaaggcugcagcagccgcagccaccagggccuaguccuggcaccggccccuccagaccacgcgccccaagcacucgcucacggaggcgggugagggcccggcgccuacccugucagcgcgggccggagggugacgaggggaccggcgguacagaccagagggagcgcgccgggcaggccgcagccgcagcagcacugaccuguccucgcccccgcgcgugggcugcggcccucgcagcugcggccgccucacugguccuugucgcccucguccaccgccgccgcccgccaccgccucguucccuuucgcuggcgccaccgccgggucucaugcgggacccgcgcuucuccucaggaaaccgaggccgagaggccaggcgccugggcaaccuugaagucggcgcugaagcgcugcugucgcgaucuguccacaguggggggcgagggcggcgagcaacuccgaagagaagcagaaggaggcgccaccgucagcgacaggucgacggaagagaagcguaacgaggcggugaacagcugcguggcccggugcgcgagcgagagagcgagcgcaggaggggcgacgaggugcuggcaaagacgaaaggcccugucgucuccuggagucacccaaagaggagcgccaccaucuugggagaaauacggaucucgcgaacgcagcacuggacgagaggacuaggugggcggaccgaguaucccgacagg

SEQ ID NO: 12129 - RNA, 9859 nt, Mus musculus
guggaaugaaccauucccuuugggggagguaggugaaauucuaguguuagaccacuagaaaggggaaaguuccuacauaaaugguuuuauagagcuuuaaauuugaagaaaaaauacuuacaggacuauuuaagagcaaucaggugauuuccugucugugagcacccccacagaggcucauggugcuggcucgagcuaagccaagcgccgcggagggucaauuucagucaugcagguuuuaagaaacuccgggucguggcuccugcgguccugggcuggacauggaaugaccagguaaggauuacucuuucgaacccacugucacucucgagccugcccgccuaccuuccuuccagaccuaugugccacuugaaccccccaaaauaccguuaauccagucccucaucguacucucucucucucucucuuuuuuugccccccagguuugugggcauugccccagcuaagaauauccacaccggagccccgagauuagaagacucagcugccaggcagaacacugaaagggaagcggcuccaagucgcuucaggugaggguaaguggaugcagcgcucuggaaaguugcauccugugacuucugcccgacaccguccaaaaucauagaaaaaguuaauuccuggcugucauuugccaucugugggagcuugugcaaaucagcacacuauacguggagauaaugcuuagagggguuguugggaaaauagagggaugagcaggggcauaagguagcuguucaauuagcaacuguuagcuaaguguccaauguauauaaauaccagcuuucuuuuccuugugagauaagcuuuagauccgacuagcagcuuucucugccuccaacauaaaaugucuugaagaaccacacuaacugcacaucuagauugugccuuucuuaauuucgugccuagcccugggaccuggcauccugcagcaucccacuaguagaaauacuuaauaugcaggcgguauauauguucacuuaccuucacaucuguuuaacaguuacaaaagcuacuacuaccuguugaguaccaggauaaauacaggaaauauagguuaugucuccccagaaguaguacacaacuugcaaaaacaacacacaggcaaauguauuaaccauaaucugaucaaaaggauaauagagguaagaacuggcuggacauuuaagagaguaaggcacacuugaggaauucaggaaagacuaaguaccguggacuguggaagugacuaggaucucagcuggacaagaucauugugaucguggcaggcaaggguaacgucuguggaaaggcaggcugucagaacuggcuugugaugccucuagaaaggcauuucggaaccuguggguugcaaccccuuugggguuccuaaggccaucagaaaacacacauacauacguuacgauucauaacaguagcaaaaucacaguuaggaaguagcaacgaaaauaauuuuauggcugggggucaccacaguauaaggaacuguauuaaagggucacagcauuaagaacacugaggaccacugcucuagaaggauccaaauggcagaggacagcccugucucccuagagcuuuuacacuuuauccccugcaggcaacgaggagcuacugauggaauuugauccaggaccguuguagccguucauuuggcaaucccagacacuacuaggauuguugggguucugucccugcuccaacaguaaagcaggcaaucaggcauagccguaucuguccaguucugggacgaguugaugccaugucauucacucacucauucauucguucauucauucauucauuuuuaggauggccuugcugugcagcccaggccacccucagacucacaauccucuugccuuggccucuugggugccugaauuacuagagcaugccccagccucagccuuacucuuuagggagucuauaaccacuguguugaugugaagccauggggagcaagaauggaagcugagaagacuugaaagcaguuagaaagcaguggauauagguaaaaauaauggugucuggaauagggugauaguuuuacuagccagcggacuuugguuuuuguguuuuauuuuguuuugagacaaagucuugcugugcaaccuaggcuggccuggaaugugcggcaguccuuagucucccgggugcuuagggauuacaggcaucuguccacacccagcuacagaucuguuaauauaaaaugugagaaaaggagaggugugaaggcucaaaacugggcgccaaacaacugaaaauauggaauuguuauauauuaaaaugucagggacuaagaguugagaucugugugguuaaguuuaagaugccuuaugcuugcuuucgaaaggccuuguguaaucauguauaauaaaagaaaacauuugagacacuuagcaucagaguaggaguagagaugccauauagacggauaucuggaaggaggaagaaccagcaaaagaaaacuccuccccaagacaggaagaaagccagacaagauuucccuuuuaguguggugcagcaaaguagggacccgagccguguuuggcacugcagacaggaugggguggcaagcagcuagcaugauugcucauuggauuuaacaguauggaggugguuggugaccuucaguacagccuuucugauggagagcucagaaauaacuucucauuguuucaaagaaaauaaacaaguauugucauuccuuuaaggaagcauugcuguaagggaaaaugagaaguucuuaggaacuugggguuuaaaauguguggaguuuugggugggggguuguuugggguuuuuuuuuguuuguuuguuuauuuguuuuguucuuguugucuugacuuuaugacaugaccguauguuuugcuucugggaaccagagaaagacugauacugaagugggaacauugccagagcaguguccuuguggggcuagugaugcagcuggagcgcgaugacaggagaguccuccaaggccuugggcacagauguuccgugguggaagcuggaaggaagucugauugauucuauuucucugcagaggccaucagcuggccccgaggaagcaggcagggcucagauguuuacagagacaaaaggaaauauagaagaggcauccaggagagugggaggauaacugaauugaggaugauugucaggcaucuugagagccugcucgaugcuggcaauucauuaagaugaagcacugggucuugguugagucagauuuugccccuccccacccccagguucuuagcagugucuaaaaaguucuaguggucauaaauuaggagauagaauccagugaaguaaagccagagaugcuaccaagcaccccacuguucccaaggcagccccccacagaaguguuaaauccaaaaugucagucaaaaagcccugguguagagagagaccagucaaccaugccguguuugcacagacucaaauuaucuagagagauggauuuaacaagggcugggaguuugccaggagacugugaagagagacaggggaguugagacuaggauuuaguccccgugaggagagaaguaguaccugagguauguggagugacagcaaucugacgggcuccucagagugcugcccugaagauagcaaggggucaggggcgggggugaccaggaaugcuugaagccaaaguuaugaugcaugcguugguaaugauaauggcugccugagaccccaaaaagugcauagccaagguaggacagaugacgguuaaaggagacaagguuuagaaauaaaagugcagaucuuuuggagaccuagcagaauuagucaguagcuauuuagaaguagugccagaugacacugagccagcuaugguguuugcaguuuauuugcauuuuaaauauuuuuuuaaauuaaauauaaguguaucaucccccuuccauuuucucuuuguaauacuuccuuuauaucccccucucuccuucucaaauguauaaccucuuucuuuuuuuuuuuuuuauuuaauugucggagguguauuccuaacuacauaaauauuaccugaucagucuguauaauguuacuuguaugaauauuaccucaggguugaccacuugggauuggaucucccauuuucaguauuccuuaauugcuuauauuugcacuuuuaaagauuuuacaauuaagccaggcaugguggagcacacuuugauuccaguacaguacaagcgggggcaaguagaucccuguauugggggauagccuggucuacauagugagcuccaggccagcuagagcuauauacugagacccucaaaauaaaacaguccauugguaaaugaaccuccccgccaugagagaaggcagaaagacuagucccagaaagcucuaucucucuuagagccuuccuuagaagaacucaguauaccuucaaccugagagaaucuugucuuguuuuguuuugugauuggcucuugcuauguagcccaggaugaccaggaacucugucaucauagcuggucuuaaacucaugguugcucuccuggcuggggugucuugaucuuggccaugcccuagauuaaguggcuuaggcuccuaguuuagaucuugcuauauaaagggcauuguacugguuuuacucagacugacacuuguauuugcacaacacggguggggaauccauggagaaaugauggucacugaaacaguagugucaucuacaggacugggacacuuuccuaucaguacagaagcugauaggccagccgcccacagaggcugugugucaagcuaagacugggccacagaaagcaaugcagugugcugagcuuuugaaaauaucccuacagaagcagauggggcgggguggggggaugcuugaaugguagcguguuuucagcauaguagaaaugcagugugggugugugaguacaagucugagucugauuuagguguguaggcauaaugaaacagccgagugacucccaucugaaaugcugaaugacagugcugugcguguuuacacuuauaaagaacacagacccaaggccaguccccugggcccaaggccuggcuuuucgugcgcgcuagcccucuuucuguuugggacuugaguucuccaccugaacaggaagacuccagccucaggggaacccaguaacccagcacaccgucaaggccaguguucccaacgcugaaacacuagagucuccauaagguuugacccguaacaggagcagagcgccuccuccagagccagggguuugucagcgcuuuuuugaucugguguguguguugggggaaggauggugugggagguuugaggccuuuuguggugguagauaacagaggcugggcagucuuacgguauauccuaagcuguacguaucccuguuaaccuugaauucagccuuccacccugcccuccaccuugcuuggcucacaguauucaacuauuuuauuuuauuuuauuuuauagcauguauguauuuccuuugauuuaaagaacuaacaaucaggaaauuaaagaaaauguuucuucugauugcagccuuuacccuccgguuccaggacaggagagcucucugcagugggcagggaugaaguuugaggacgucccaauugcacacauuaaagcaaccuacaacaaguaagaaaagggugcccgcgugaguccccuaggaacugcuucugccucaggccuucuuggaguagaagucgggugucagaugcuagcuucgucucuucuuucuuuauaagcuuacucaaguuucaugaaacuauaaaauagauugaguacaguguaauuguaaggguuucugccguccuugggacuccuaugcuagcaucagaagggcugcauucgaagcaaguggagagagaagcagugcucagauacaugauuuacuuguaaaguagccagaauguauaagccccuuaguuagccuucuuaccuuaggcccugugcacugcccuuucccuagcagggcuaaguguggcggugaaggaaagacuacugugugcuguggggugcuagcacaagacacaggugcaguugggcucccagcugcagaagcauagggcacuggcgacagcuuugcaggcuagguccuacuugaaagugggaucugaguuugguggcauccugccugccacacaguugcagcacagcacuggagacgauaauccuggccuagaaugcgagcacccaagagccacagagccuacagcagcaucucucucccuucucgugagcuaaugcagacguggcuucugagcucuccacacccugcugugucugugccuuuucaguacgcccugaaugagaaugcuucuguguagcuccugaaguguaagcgaccccaggggaggagugaacuccauaacaagaccaacaggcagguggucccugcucagggcugacccagcaggucuccuggacagcuccccuucacuuuccccuucccaggaacacccagaaagcucugcagaaaguggggugaugauaaccaaaggggagacagaaaacaugccuuagaauuugcuuaaagucagucuugggggguggguguuuucuagacaggguuucucuguguagccgggcuguccuaaaacucacucuguagaccaggcuggccucaaacuuagaaauccaucugccucugccucccaagugcugggauuaaaggugugcacuaucacugcccagcuuaaagucagucuuaauuacaauuuaccauuuuaaagcaaauuaggaaaaagcuucacuuacuuaaaauaauuuuuggucagagaauagaaugucauaagcauuugaauuauaauaauauuauaggauaacugguuuugugggauuauuuugagucuuuaugguuaccucugaaaugauagauacuagauucgcuucaaaacagcccauggaugagggcauguagcggguuuagaggagacacuguauuuggaugugacggucauuguuggagcagaaugagguaacaggucucuggcauuuauucauaaacuuuuuuaaauuaccuuauuacauguuuacuuaguugucaggagugaucauaaacaugagguggucagagaacaauuugcacaaauucucucuucccaccgugugggugcaccuguaagccaucccucacacacucuucuuuacauuguuguaguggaagauacucgaauuuucucagcauugucuuuuuaacaguugccuaaugcaacgcauguagguuuuuauaaaacaccaagcgaugucacaucagggaaaaugcugccccagggaaggcuucauucaggaggaagugguuccuucgggugacgcuccccuguugggugacgcucuccugcccuuggauuauggcacucccccuaagugugugauuugcccaucuuccuuuagcggaggaagcuaaugaccuuuucuuucucacuguggcuccuaaggacuuuagcaagcucccuuccuuccugagcaguacuagaucugugugccuccuuuucccagcacacagauccagguagucucugccaccaaugcgucccuggcccgcgccuccuguggcacagaaggcuuucgcaaugccaagaagggcaccggcaucgccgcacagacagcaggcauagcugccgcagcaguaaguaccugacuacguggcuccacuuuccuuguggcuuacaguggggaagucucauuaaaccagauucggaaaccagcacaugccaguguuugggggccucugaucuuugcccaccccuguuagaugcccugacacugccgcugcuuuaagaggccuuuguagaaagguuaccaacuuucucucucagcuucaguggagaagaaagaugucauuuauguucagaggaauaagcagagagcugaaggcuuaggaaccaacacucccuccaugaaagaccacugggcuguauucuauucaggaagcaugucuuauagcacgggucccaaaaugacgucauagaucuuucuagaagcaaaucaggcagcuccauuucagacacuucauuaguacccugucuucagaagagccugcuauuagccacucuuucaagagacucggaugcuggggauuggucagagucagggagccaguugagcucucugaugugaacccagaugggccuugagccagagcugcguguuuucugguauagcaaagaccacagaugugugcacucugacaagcaggauacuuccugaaggaacaccuugaccuuuaagcuagacguaaggcaaucuuugacugcuaugaguagugaucaccaaagcacagaacgauguaauugcccaucagaccaucagacggagcauagucggcuaagcagcacaugccaguguuugggggccucugagugguagcucuugaguaucuuccaggaccuguagugaauguguuccuaaucuggacacauacuuaacuguaaagaaacuaaaucccacugucuaagugggcccgaccuugauauccauggugacaccucagcauuuggaggaaaaccaggcaauaucuacaaguguccauuagauggcagugcaguccugucaccuucguuccuuggcucuguucacuagcaucuacccuuguccacuaggccuuaacucccucugugucuucugccucacuguuugcuucugucauugcccuuaucccaugaguccuggggacaguagccagagacugggcugcagcacugucucaggggcauugacacuugccucucuccagaaagccacaggaaagggagugacccacaucagagucguagugaaaggcauggggccaggacgcuggguaaguuacuagcgguucuccugggggggggggggggucuguguauguaugucuguguguaucugugugucuguguguguguguauguauauguaugucuguaucugugugucuguguaugugugugugcgcacgcgcgugugcauacacgugcacaccuguucuucagagucagguauagagauagaaaugucccuuagugagugacaugguauuguuuaaaguuccuuucuguuccugugaucugcuaauccccgcagagcaagccugggucauggauuaauuuauuaccuucuugggucccagccccuuggauggaaaaguagucucugggggaccaucucaagcaaguccucagcacagacagugaaugcgauggagaagggucaaggcgcugggcaccuugagagggauucugagaccaguggggcuagagcuuccuccaacaaaugacaucucucugacuuuaaaagaacgagauguuggggugugagugugugugucccaggagaagaaaacacuccuguaaagcuaccagagugcauagauagaaccucuuuccagacuguaaaacacaagguggaggcagggggcuggaaccguagacaucaacagugagcuuccauccuucucgagcccugccugacgauggcggucaucauuuugaagccugugccuuuugccuauuucugaucuuuccagucugccaucaaaggacugaccauggggggucuggaagugaucucaaucacagacaacaccccggucccacacaauggcugccgaccccggaaggcucgaaggcugugacgggaagggagccugcacuuggaccuggccucaggucuugacuccuguggauccuacagaaggcccacuguggaagccgcuggagccggcuguucucgagcccuccuuggggaaacacuccucuccucgcaccgaggcuggaagugccaagcuggccucuuggacaugagggagugggaaccccaggcccacuguggccagcucagccucugcuccaaaaauaaaaaacuauucucugu

SEQ ID NO: 12130 - RNA, 9859 nt, Mus musculus
acagagaauaguuuuuuauuuuuggagcagaggcugagcuggccacagugggccugggguucccacucccucauguccaagaggccagcuuggcacuuccagccucggugcgaggagaggaguguuuccccaaggagggcucgagaacagccggcuccagcggcuuccacagugggccuucuguaggauccacaggagucaagaccugaggccagguccaagugcaggcucccuucccgucacagccuucgagccuuccggggucggcagccauugugugggaccgggguguugucugugauugagaucacuuccagaccccccauggucaguccuuugauggcagacuggaaagaucagaaauaggcaaaaggcacaggcuucaaaaugaugaccgccaucgucaggcagggcucgagaaggauggaagcucacuguugaugucuacgguuccagcccccugccuccaccuuguguuuuacagucuggaaagagguucuaucuaugcacucugguagcuuuacaggaguguuuucuucuccugggacacacacacucacaccccaacaucucguucuuuuaaagucagagagaugucauuuguuggaggaagcucuagccccacuggucucagaaucccucucaaggugcccagcgccuugacccuucuccaucgcauucacugucugugcugaggacuugcuugagauggucccccagagacuacuuuuccauccaaggggcugggacccaagaagguaauaaauuaauccaugacccaggcuugcucugcggggauuagcagaucacaggaacagaaaggaacuuuaaacaauaccaugucacucacuaagggacauuucuaucucuauaccugacucugaagaacaggugugcacguguaugcacacgcgcgugcgcacacacacauacacagacacacagauacagacauacauauacauacacacacacacagacacacagauacacacagacauacauacacagacccccccccccccccaggagaaccgcuaguaacuuacccagcguccuggccccaugccuuucacuacgacucugaugugggucacucccuuuccuguggcuuucuggagagaggcaagugucaaugccccugagacagugcugcagcccagucucuggcuacuguccccaggacucaugggauaagggcaaugacagaagcaaacagugaggcagaagacacagagggaguuaaggccuaguggacaaggguagaugcuagugaacagagccaaggaacgaaggugacaggacugcacugccaucuaauggacacuuguagauauugccugguuuuccuccaaaugcugaggugucaccauggauaucaaggucgggcccacuuagacagugggauuuaguuucuuuacaguuaaguauguguccagauuaggaacacauucacuacagguccuggaagauacucaagagcuaccacucagaggcccccaaacacuggcaugugcugcuuagccgacuaugcuccgucugauggucugaugggcaauuacaucguucugugcuuuggugaucacuacucauagcagucaaagauugccuuacgucuagcuuaaaggucaagguguuccuucaggaaguauccugcuugucagagugcacacaucuguggucuuugcuauaccagaaaacacgcagcucuggcucaaggcccaucuggguucacaucagagagcucaacuggcucccugacucugaccaauccccagcauccgagucucuugaaagaguggcuaauagcaggcucuucugaagacaggguacuaaugaagugucugaaauggagcugccugauuugcuucuagaaagaucuaugacgucauuuugggacccgugcuauaagacaugcuuccugaauagaauacagcccaguggucuuucauggagggaguguugguuccuaagccuucagcucucugcuuauuccucugaacauaaaugacaucuuucuucuccacugaagcugagagagaaaguugguaaccuuucuacaaaggccucuuaaagcagcggcagugucagggcaucuaacaggggugggcaaagaucagaggcccccaaacacuggcaugugcugguuuccgaaucugguuuaaugagacuuccccacuguaagccacaaggaaaguggagccacguagucagguacuuacugcugcggcagcuaugccugcugucugugcggcgaugccggugcccuucuuggcauugcgaaagccuucugugccacaggaggcgcgggccagggacgcauugguggcagagacuaccuggaucugugugcugggaaaaggaggcacacagaucuaguacugcucaggaaggaagggagcuugcuaaaguccuuaggagccacagugagaaagaaaaggucauuagcuuccuccgcuaaaggaagaugggcaaaucacacacuuagggggagugccauaauccaagggcaggagagcgucacccaacaggggagcgucacccgaaggaaccacuuccuccugaaugaagccuucccuggggcagcauuuucccugaugugacaucgcuugguguuuuauaaaaaccuacaugcguugcauuaggcaacuguuaaaaagacaaugcugagaaaauucgaguaucuuccacuacaacaauguaaagaagagugugugagggauggcuuacaggugcacccacacggugggaagagagaauuugugcaaauuguucucugaccaccucauguuuaugaucacuccugacaacuaaguaaacauguaauaagguaauuuaaaaaaguuuaugaauaaaugccagagaccuguuaccucauucugcuccaacaaugaccgucacauccaaauacagugucuccucuaaacccgcuacaugcccucauccaugggcuguuuugaagcgaaucuaguaucuaucauuucagagguaaccauaaagacucaaaauaaucccacaaaaccaguuauccuauaauauuauuauaauucaaaugcuuaugacauucuauucucugaccaaaaauuauuuuaaguaagugaagcuuuuuccuaauuugcuuuaaaaugguaaauuguaauuaagacugacuuuaagcugggcagugauagugcacaccuuuaaucccagcacuugggaggcagaggcagauggauuucuaaguuugaggccagccuggucuacagagugaguuuuaggacagcccggcuacacagagaaacccugucuagaaaacacccaccccccaagacugacuuuaagcaaauucuaaggcauguuuucugucuccccuuugguuaucaucaccccacuuucugcagagcuuucuggguguuccugggaaggggaaagugaaggggagcuguccaggagaccugcugggucagcccugagcagggaccaccugccuguuggucuuguuauggaguucacuccuccccuggggucgcuuacacuucaggagcuacacagaagcauucucauucagggcguacugaaaaggcacagacacagcaggguguggagagcucagaagccacgucugcauuagcucacgagaagggagagagaugcugcuguaggcucuguggcucuugggugcucgcauucuaggccaggauuaucgucuccagugcugugcugcaacuguguggcaggcaggaugccaccaaacucagaucccacuuucaaguaggaccuagccugcaaagcugucgccagugcccuaugcuucugcagcugggagcccaacugcaccugugucuugugcuagcaccccacagcacacaguagucuuuccuucaccgccacacuuagcccugcuagggaaagggcagugcacagggccuaagguaagaaggcuaacuaaggggcuuauacauucuggcuacuuuacaaguaaaucauguaucugagcacugcuucucucuccacuugcuucgaaugcagcccuucugaugcuagcauaggagucccaaggacggcagaaacccuuacaauuacacuguacucaaucuauuuuauaguuucaugaaacuugaguaagcuuauaaagaaagaagagacgaagcuagcaucugacacccgacuucuacuccaagaaggccugaggcagaagcaguuccuaggggacucacgcgggcacccuuuucuuacuuguuguagguugcuuuaaugugugcaauugggacguccucaaacuucaucccugcccacugcagagagcucuccuguccuggaaccggaggguaaaggcugcaaucagaagaaacauuuucuuuaauuuccugauuguuaguucuuuaaaucaaaggaaauacauacaugcuauaaaauaaaauaaaauaaaauaguugaauacugugagccaagcaagguggagggcaggguggaaggcugaauucaagguuaacagggauacguacagcuuaggauauaccguaagacugcccagccucuguuaucuaccaccacaaaaggccucaaaccucccacaccauccuucccccaacacacacaccagaucaaaaaagcgcugacaaaccccuggcucuggaggaggcgcucugcuccuguuacgggucaaaccuuauggagacucuaguguuucagcguugggaacacuggccuugacggugugcuggguuacuggguuccccugaggcuggagucuuccuguucagguggagaacucaagucccaaacagaaagagggcuagcgcgcacgaaaagccaggccuugggcccaggggacuggccuugggucuguguucuuuauaaguguaaacacgcacagcacugucauucagcauuucagaugggagucacucggcuguuucauuaugccuacacaccuaaaucagacucagacuuguacucacacacccacacugcauuucuacuaugcugaaaacacgcuaccauucaagcauccccccaccccgccccaucugcuucuguagggauauuuucaaaagcucagcacacugcauugcuuucuguggcccagucuuagcuugacacacagccucugugggcggcuggccuaucagcuucuguacugauaggaaagugucccaguccuguagaugacacuacuguuucagugaccaucauuucuccauggauuccccacccguguugugcaaauacaagugucagucugaguaaaaccaguacaaugcccuuuauauagcaagaucuaaacuaggagccuaagccacuuaaucuagggcauggccaagaucaagacaccccagccaggagagcaaccaugaguuuaagaccagcuaugaugacagaguuccuggucauccugggcuacauagcaagagccaaucacaaaacaaaacaagacaagauucucucagguugaagguauacugaguucuucuaaggaaggcucuaagagagauagagcuuucugggacuagucuuucugccuucucucauggcggggagguucauuuaccaauggacuguuuuauuuugagggucucaguauauagcucuagcuggccuggagcucacuauguagaccaggcuaucccccaauacagggaucuacuugcccccgcuuguacuguacuggaaucaaagugugcuccaccaugccuggcuuaauuguaaaaucuuuaaaagugcaaauauaagcaauuaaggaauacugaaaaugggagauccaaucccaaguggucaacccugagguaauauucauacaaguaacauuauacagacugaucagguaauauuuauguaguuaggaauacaccuccgacaauuaaauaaaaaaaaaaaaaagaaagagguuauacauuugagaaggagagagggggauauaaaggaaguauuacaaagagaaaauggaagggggaugauacacuuauauuuaauuuaaaaaaauauuuaaaaugcaaauaaacugcaaacaccauagcuggcucagugucaucuggcacuacuucuaaauagcuacugacuaauucugcuaggucuccaaaagaucugcacuuuuauuucuaaaccuugucuccuuuaaccgucaucuguccuaccuuggcuaugcacuuuuuggggucucaggcagccauuaucauuaccaacgcaugcaucauaacuuuggcuucaagcauuccuggucacccccgccccugaccccuugcuaucuucagggcagcacucugaggagcccgucagauugcugucacuccacauaccucagguacuacuucucuccucacggggacuaaauccuagucucaacuccccugucucucuucacagucuccuggcaaacucccagcccuuguuaaauccaucucucuagauaauuugagucugugcaaacacggcaugguugacuggucucucucuacaccagggcuuuuugacugacauuuuggauuuaacacuucuguggggggcugccuugggaacaguggggugcuugguagcaucucuggcuuuacuucacuggauucuaucuccuaauuuaugaccacuagaacuuuuuagacacugcuaagaaccuggggguggggaggggcaaaaucugacucaaccaagacccagugcuucaucuuaaugaauugccagcaucgagcaggcucucaagaugccugacaaucauccucaauucaguuauccucccacucuccuggaugccucuucuauauuuccuuuugucucuguaaacaucugagcccugccugcuuccucggggccagcugauggccucugcagagaaauagaaucaaucagacuuccuuccagcuuccaccacggaacaucugugcccaaggccuuggaggacucuccugucaucgcgcuccagcugcaucacuagccccacaaggacacugcucuggcaauguucccacuucaguaucagucuuucucugguucccagaagcaaaacauacggucaugucauaaagucaagacaacaagaacaaaacaaauaaacaaacaaacaaaaaaaaaccccaaacaaccccccacccaaaacuccacacauuuuaaaccccaaguuccuaagaacuucucauuuucccuuacagcaaugcuuccuuaaaggaaugacaauacuuguuuauuuucuuugaaacaaugagaaguuauuucugagcucuccaucagaaaggcuguacugaaggucaccaaccaccuccauacuguuaaauccaaugagcaaucaugcuagcugcuugccaccccauccugucugcagugccaaacacggcucgggucccuacuuugcugcaccacacuaaaagggaaaucuugucuggcuuucuuccugucuuggggaggaguuuucuuuugcugguucuuccuccuuccagauauccgucuauauggcaucucuacuccuacucugaugcuaagugucucaaauguuuucuuuuauuauacaugauuacacaaggccuuucgaaagcaagcauaaggcaucuuaaacuuaaccacacagaucucaacucuuagucccugacauuuuaauauauaacaauuccauauuuucaguuguuuggcgcccaguuuugagccuucacaccucuccuuuucucacauuuuauauuaacagaucuguagcuggguguggacagaugccuguaaucccuaagcacccgggagacuaaggacugccgcacauuccaggccagccuagguugcacagcaagacuuugucucaaaacaaaauaaaacacaaaaaccaaaguccgcuggcuaguaaaacuaucacccuauuccagacaccauuauuuuuaccuauauccacugcuuucuaacugcuuucaagucuucucagcuuccauucuugcuccccauggcuucacaucaacacagugguuauagacucccuaaagaguaaggcugaggcuggggcaugcucuaguaauucaggcacccaagaggccaaggcaagaggauugugagucugaggguggccugggcugcacagcaaggccauccuaaaaaugaaugaaugaaugaacgaaugaaugagugagugaaugacauggcaucaacucgucccagaacuggacagauacggcuaugccugauugccugcuuuacuguuggagcagggacagaaccccaacaauccuaguagugucugggauugccaaaugaacggcuacaacgguccuggaucaaauuccaucaguagcuccucguugccugcaggggauaaaguguaaaagcucuagggagacagggcuguccucugccauuuggauccuucuagagcagugguccucaguguucuuaaugcugugacccuuuaauacaguuccuuauacuguggugacccccagccauaaaauuauuuucguugcuacuuccuaacugugauuuugcuacuguuaugaaucguaacguauguauguguguuuucugauggccuuaggaaccccaaagggguugcaacccacagguuccgaaaugccuuucuagaggcaucacaagccaguucugacagccugccuuuccacagacguuacccuugccugccacgaucacaaugaucuuguccagcugagauccuagucacuuccacaguccacgguacuuagucuuuccugaauuccucaagugugccuuacucucuuaaauguccagccaguucuuaccucuauuauccuuuugaucagauuaugguuaauacauuugccuguguguuguuuuugcaaguuguguacuacuucuggggagacauaaccuauauuuccuguauuuauccugguacucaacagguaguaguagcuuuuguaacuguuaaacagaugugaagguaagugaacauauauaccgccugcauauuaaguauuucuacuagugggaugcugcaggaugccaggucccagggcuaggcacgaaauuaagaaaggcacaaucuagaugugcaguuagugugguucuucaagacauuuuauguuggaggcagagaaagcugcuagucggaucuaaagcuuaucucacaaggaaaagaaagcugguauuuauauacauuggacacuuagcuaacaguugcuaauugaacagcuaccuuaugccccugcucaucccucuauuuucccaacaaccccucuaagcauuaucuccacguauagugugcugauuugcacaagcucccacagauggcaaaugacagccaggaauuaacuuuuucuaugauuuuggacggugucgggcagaagucacaggaugcaacuuuccagagcgcugcauccacuuacccucaccugaagcgacuuggagccgcuucccuuucaguguucugccuggcagcugagucuucuaaucucggggcuccgguguggauauucuuagcuggggcaaugcccacaaaccuggggggcaaaaaaagagagagagagagagaguacgaugagggacuggauuaacgguauuuugggggguucaaguggcacauaggucuggaaggaagguaggcgggcaggcucgagagugacaguggguucgaaagaguaauccuuaccuggucauuccauguccagcccaggaccgcaggagccacgacccggaguuucuuaaaaccugcaugacugaaauugacccuccgcggcgcuuggcuuagcucgagccagcaccaugagccucugugggggugcucacagacaggaaaucaccugauugcucuuaaauaguccuguaaguauuuuuucuucaaauuuaaagcucuauaaaaccauuuauguaggaacuuuccccuuucuaguggucuaacacuagaauuucaccuaccucccccaaagggaaugguucauuccac

SEQ ID NO: 12131 - RNA, 7706 nt, Mus musculus
agcgcggaggaggacgguagcucggucacggcguuuggagucguuguuuuuccuauaguuggagucgaggucaaaccucucguggaaccugccucaagaugaugaacggccggccgggccaugagcccuuaaaauucuugccggacgaggcccggagccugcccccgcccaagcugaacgacccgcggcuugucuacaugggcuuguugggcuacugcacgggccugauggacaacaugcugcggaugcgaccggugaugagagcaggugagggcugcgggcgaucccgcucggacgaggagcugcaggguugcccgcugaggucaucugugcucuacgaggccuuccugccuagcugggggcgccuggcucucccagggcgugcauccccucucggguucucagcgccaagaguagccacauugaagaaaaccaagugcagugcaauggggacuucuaaaccccacgguuaagucugcgaaggacucaagaagggcuccucacaguucgcguuguacuucgugcuaaacgguugcccagcccauuucucucagacgugagaaaguauuguacugacgagagcacgagacccaagcagaguuaaagcaccuugcccacggucuaguuaaagagaggagcuuguguuguguuggugugugcuuagaaccagagcuucucagaguuggagugcauagaaauaauauacaguuaaaauauugguuugauucauaaggucuggggagaggacuaauguggacaaaacuccagacgcuacuacugcccuuauucuggaauaggagacugucaauaaacuagcaagcuguauauucuaguuugucacuggcuucuggucacgauugagaauagcuuagcuuacacaauguagcugugcuaagaacuguagaauuccaaagauacauguagaagcaaacuaacugucuuuguuauaguuauucuuuauauggggggggggguagaggggagauaacaaccugaauuaguucucucuccaauaccgugucagcccuggggauugaacuccccaagucagacuugguggcaaaugucuuuaucaugucacuagaugugaacuuaacuuugaauaucaagcaagaguuaaaagaacuucguaugucuggggguggggguggggugugcaaggcguucugaaagugggugaauuugauuacuuagcugcaagauuacagugauaaggcugcagaggcuaucagacgagggcaguuuauucucuggguggggaagacaugaaaacuuuugagaacugaggaaguucaguggugagggucaguuuugucagcaaucuaaaccaucaguuggcgccaaggaccacagcacaagaaugcuaaugaaaugguuccagccacuaggacucaucccagcuaaucgucuguguuagacaugaaggucagcauccaugacauccuagggucacuggucacuaguccucaaauacuauuggaagccaauaugucuuggaaaugcucguucucucucucucugucucucuguguguguguguguguguguguguguguguguguguguguacacucacacacacgugcacgugugugucugaucaugccuaagcuugucguuugggaacuacaugguuuuauuucauuguuuccugccugugucacucuggcgagucaugugucaaucugccagucuccucaucuaccaagugagaauccuuguguauucguugugacgguucagugaguucuguggauuagguacacaacacacaaaaggugcugagugaggggaacugacuggacuucucugccagaccuugggguuguacauccugaguaugggagaagaacugaccuuuagaagccagucagccagaaauacaaaucauuguguugcuggucuuggagugguagaugcaugcuuugauagagauggcaugauggcacuuugagagggugaaagcgguacaaaugugaggaagaauguucugcaggugguacagacaggcugcaauguggacugugcuauuuaguaccgccuuauugcuuccagggccuggagaagggcauaugcuuugugccaggcaugguggugcaugccuuuaaucccagcacuagggaggcagaggcaggcagaucucuuuucguuuguuuugccuggucuacagugugaguuccaggccagccagguuauacagugagugagacccuuucuccacaaaaaagaagagcgugugcuuuggggugugaugcugugucuccccaacuagugauuuaauuccaaggaaacucgauguuucuguaagaaaugaaguaauuuuagacagcagucaggacgagagucagaauuccuugagcauccuuacugcucuggacauagccgugcuggagccuguuuccucuacaguauuuccugaacacauacuguguuggucuaacucaguguucuuaagccuucucuacuuacagcauauuucugucaguacauuuuuauguaacccccaguauauaggaguuuuuuguuguuuuguuuguuuguauuuuguuuguauuugagacaaaaaucucaauauguagacuaggcuguuguggaacucagaggaauccuccugccucugccucccacguguugagauuaaacuugcucaccaccauggcuggcuauauuuuaaauagauauauaaagcaacauuuacugaaaguaaaucauaaugcaguuuauuuuaaaacaguuuuuuuuuagucagucauaaguuuucugcauuagauuucucaucacugugauaggauaucuggauaaagcugccaaaagaaaggaaaggcuugcuuuaaaggauucagaagaaaauguagcagcugggccuaguggcucacaccuuuaguccuugcacucuggagacaagacaggcauuucuaugaguuugaggccagccugggcuacauagugaguuccaggauagccagggcuacaugaugauaccuugucuaggaaaaaaacgaaugaggaagugccaugggugcgcacacgcacgcacacacacacacagagagagagagacagagagagagagagagagagagagagagagagagagagagagagagagagagaacuugagcauuuccaagacauauuggcuuccaauaguauuugaggacuagugaccaaugacccuaggaugucauggauguugaccuucaugucuaacacagaugauuagcugggaugaguccuaguggcagaguaacacaagagagugcuaaaucugcauguagucuuucaaaucgagcaucagacuuauauagucauuacagaagaaaacauggaaguuaggugauacaucagccaagauacauugagguugucaucugaugcacaaugacucuuuacacaaaacugagaaaugcauacauaaagacuagcaggaaccaggcagugguuacaacugagauaaaaaggggcccuauggcuaucauaagaaccagcugugaggauuuugcacccuagucacaauucuagucuauuguauaacccaccaccaggggucccuuaguaagcaccuaauuaugcuauuccucugggccuugugaaaacuugcacuuggggaguucugcucuugcuaaccuuuucaugaauaauacaguacucuaguuccuccuuaaaccacaacccaccuuuccuagaccauuguaaaucccugcauaugggaguaacucggcuguaauucugaguaccuguggggaaccuccaggagaccaauuaccaugaaauuuuuugccccaggacauuuugugccucaggaccucagccaagcuuuuggacuugucacacagacucuacuggagugggugugacaaggaagaaaaagaaaggggaggagggguagucacccuauggggguggcucacaucugaacagaucaggaaacauagaugggacaggacuuggggucagguuauaagaccucuggcccucaaaaccagagacccagguagagccaaccuccuaaagcuccacagccucccaaaauagggucaccaacugggaaccaaaugcuugaguggaggacauuucacauuuaaaccaugauguacaguaacgagugugacccauguuucuuggagacuugagggaguggcagaggaagugaauggugggcuuuggacugaagccuuggagaguacuuagcauucuacagauagugauggaauauuuuagcagugaaguaaacuuauaccagucuuuuuuaaguuuguagaaaauacuaaauaaaaugucuucuuauucuauuccugucaucuguguuuuaaaacccuggcugauaacuccuucaaguuaguugguuauaaagucuaaaauuaaauguuuguugauuuuuagcgugacaaugguaaugcacuguauguaaauggcauaauggcuuccauguuuagguucaucaauaaaggaaagaaagggaaagugguuguggagggaaaucccagagagaaggaagcugaggggaugggaaccuggagaacagcuaagcuaugccguuagaguguggggaccuacagcaugugugagucuucugcugagacuugggggucacgguagagccuggucuuuguguagcucggucgcucaguggagggcacgggacacugcucagagaaccaguuuggggaauuaguggcugcagcucuagacugaagaauaucguguagggauggagagauggcucagcgauuugauuuccaguauucacaugauggcucacaaaugccuguagcuugaguuccagaggguccaauggggaguugggccugcacaggcuuuuacauguggugcacauaaguauauacuucacucucacacacacauaaaauaaaaauaaauauuuuuaagagacuaucuuacuuuuauugcuuuuucacauuuuccagaccaccuuuauauacauuuuaucuugguuuguauauuacuagaacgagaaagauagaguagguauguuguuguuguuuguuugagacaggguuucucuguguagcuuuggcuguccuggaacuuggucuguaaaccaggauagccuugaccucacagagacccaccugccucugacucccaaguucugguauuugccaccacuacccaucauguauuuucucuuuguagagauaguaaauuuacuugcccaaaggcuucauuacuuuaauaaauauacauuagguguuaaaugcugauugguauagccagaugaacuagauguugcuugcccuaaugguagagacaggaacaaauuaugguacaacuuauaaaugaguucaccuuguggacuccacaaaauaggaaaccauuguagagguauugauaucggaagcuauagcaugauggugcaguugcugggcacagcaguaaccagcauguugguggguuuuugucuaaaaacuguuuuauuggguuuuacuauaucugccuccuuccaacccuuauucuacccuaaucccuuccaacccaccaacaccacuuaggagugaaaacaaagguuagagaguguggaccccuauaggcuacuuccugcugcuaaugggcaugggguucccugggacaaguccaguuuuuguugucggauauccagcaguccagcaacugggcaauccaucaauagcgagugcagcagcaggagggagcagcagcugccacagacccuuuuggggcucuugcauuuuacccucuccugaguccccagaauuaaaacuaucugcagcugucaaaaaucacgccccccagagcacaaggcagucguaguuaacagcuguggacaaucugaagcagcccauaccccacaccugggguucaaacaaaaacauaacucaggguguuuguuuguuuguuuguuuuguuuucugagacaggguuucucuuguagcccuggcuguccuggaacucacuuuguagaccaggcuggccucgaacucagaaauccaccugccucugccucccaagugcugggauuaaaggcaugcgccaccacgcccggcuaacucaggguuuuuaagaaaccacaauucaaaauuuccagagucaaaauuuccaucuucuccaaaagguauuugaaauaucuuaccaagaaauaaccuuaagaagaauaaucuccgugauuggcuacauguggucgcaucugacaaggagacuuacgaacuucguuauuuccagauuagucaagaugaagaugguucagagucuggggacuaauuggccuuugcuuguaauacaaugaaaguauucuaaagaaauauaaaauuggacuuuaugagaaaauaaaagucauuucacucuauuaaaaaaaaaaaagaaaccacaauucucaccacaccuguacaugauauuucacggagaacguuagggugagggauaaagggugagcagaaagccggaucagagcagguggcucuggccuggaagggguacacucgcuguaggggggaaagagucugggacucggggucugagugugggaaaggcuguaaaaugaaagcgugcucaacucaguggugaacagcacugcucuucugagauggagaaaggugcagagaggcaagaccugaagugcaagucccagccuaggcucuguggacccuggggggggggggaggagggggaggggagggguucuuuuuuguuuguuuuguaaagaacauuagcaagaauaccauaagaagcugggauguaacauaaacguaauucucugugcacucugacugaugguuugcuuuggguuuuguaauuccagguuugcaccgccagcuucuguucguuacguccuuugucuuugcuggauacuuuuauuuaaaacgucaaaacuauuuguaugcugugaaggaccaugacauguuugguuauauaaaauuacacccagaagauuuuccugaaaaagguaucucguguuaauugaaaaugaaaaaccgcuuguuuacuuugucucauucucccugguuaagggcucagguacuggcugcuugcguggccucaaacauguucuucuggagccuuuuauaagaacacauccauucagaggccccgccucggccuaccguagcgcuggggccugagccagcauggauuaggggagacacggcauucggcaggucuccaucaguaagaugagucccgauggccuuucucuuucaguauagcccuauuuauuuacuuaagccaucaccaugguuauuacuuuauguguuuggaugcgugccugcaugugcgucuguauacaguguauauacuugaggaggccagaagagaaugucguaucccuuggaaguggagucacagacaguuguggcagccacagacacucugggaguggaacuggaagagugcacccugacccuagccuuuauuuguuuauguuuugaaugcugaagccuaagcccagggccucagacacucagcacauguucugccccucagccacaucccuagcccaagaaauagaauuuuuaaaguauaacuuuaaaaugaauauuuuaugauucuuucacagagaagaaaaccuaugcugaaauucuugagccauuccauccagugcguugaaguuuucaaaaggcuuguuccuguuccucuucaccacaaccugaauauuuucugaguuuuaugggauuuucugugacagugaaguuuagguuaagauguuaacacuguuauuaaaauaguuauuacaa

SEQ ID NO: 12132 - RNA, 69444 nt, Mus musculus
cucugugucuuugcugccgcccuacgugggccugagugugcugcgccuugggagcuggguggcugcgcugcggcgcuuagccgaauccagccugucaggcugguucagcccgggcuuugucccaacugcugagcagggagaggugcggcucugcgacagauacacaagaucaucagagaugcugggccccggacccaccgccagguaaugcuggcuuucccugggccuggcauagcuagacugagagcugggguagaaggagcgggugucuuucugccuuccggggaagggaauggggagaacauuacauuucacuuauauuaagggauucuuaauaaggaaagggccuggugguguaacauugagauaagccccucagggcuaggccugugcuggaauaaggcaucuggcuagggaagguuaugaaggggaagcuggauuuuuuggggaacugcaugccucaggggccccacuccuuuguaagcaugcuucugcaugguggccagggugaugcuuuucugugccuugguuuagcugcgguuuuccugggacccggaauacuguucucugguuggagauguagugaagauaggagaccccugcagcuguuccuggucaggcagucucuaugagccuuaauuuccuuauuugaagagaagggcuuagcauucuguaacugugccuuuccuaggcuguaaaauuuaccuuggaaaggugagcuagguagagacagaggagccagccuuccauaugcaucuugccggucuguuuagaaccagugacuucauaaagugcuaaugcuucuguuggggcuaagaguagauauguugaguguggggugugggguugagaagaaacaggugaacgcaugcuaauuuuuuuuccugaacuggccaauucuuugauacuuagaucacugcuauaaacuaggcugucuucucuggugcacuguuauugaucugcuaaguaaauaacagaccuugacacuauguaauaucuuaaucacuguaauuccuuccuuuauuaucuggcaccaagaaauacaaauacuaaccuaugcugauuauuuuggaccuuucucaucuugguuacagaggagcuaugcauucccucugggaagccuuccugcucuuccuuucuuccuccucuuccugcuggucggcuuuccuugccugccccucaccuguuuucugaucucaccaguuuccuuucuuccuuuccuugucuucacgcuuuccacuucuugucucuuuuccuuccauaaccaugguuucuuuuuucuguuuuccuuuuucauuucuucccuggguccucuucuucuugguuaggcucucuucucuuuuccuuuuagaaucuuuuauugugcuuucucauugguaguaaguugcugacuuggagggaccuuugcugugauguuuguaagguccaaacauucuagcuuccuuguuuuggaccuaagcucuguuuuccuuaugugucaggcugucuccuuacugcccucaagcuguguuuugaggcuuccuaauaaguaguuauuuuuccuggguuuauuccccauccuuuuccuugagaaccaaggcagaaugugggcagaaggaaaaaaucaugguaggaagucaggagcuugaaggcucgagcuggagaacaaguacaaauacagcuagcuaggagaccuuccugagagccccucacugagaugagggcugggagauagccaguuuccaggggcacagugggaugaagagaagaagggggagucuuggggcaagaguguucuuuaggaagaagaggguggcguuggcaucaagauggggguuauuaggggguaaggguagcuguagagggaacgauuuauaggcuauguaaaagauguguagccauauagguucauuguuuucccuccugaugguaggcucucugaagaggauuauuuuugcucugcaucuuucucccccccccccacccccccgcccucucccgccccguaguguccuaaagugagagagucagaggggaaacagagaugagacugacaggguuauuguuucauugacacucacuaacuaauauaugcaaugugugugcauguguguaugcauauauacacacacacauacaagauaucaauuugguauccaucauuaacuguucucucugguuggugagaacauuugccaccaagcaugaugagaucugaguucuauucccauguuuuauaugguaggagagacuaauuccuacgagaugucuggauaugugagcuaugguauggucucaccacuaucccaacgcacacauguauaaauagauguaauuuuaaaaauaaacauucucucagucaccuguaguauauuaguuauggugcugguugcugaguacuguugguuuuuaaaggagguauuuagauucauuugcuguguucagaugcaggucuagggguggacccucauguguaguguagaggggagcacagggagcuaugauaauguaguggaggaagacuaagguucaacaaaucagugccagggcugcacuguaaacucaagucuucuuuaauugugauacacauuuacuuagacuauguuaucuugugacauuaggugcauguuguauauaaagaauuuucuuguuuuuuuuuuucugucuuugggaauaaaauguagauauuaaugaaauagaaaacaaauuuacaugugguagguuauuacgcccuggccaaacaaauucucagaaggaagcagacuuugucccuguuuuuuucuggcugcaggccauuuaggugacucacugcugagcacccucucugaguuauuugaucccuuucucuucccugcucucuuauauucaauuucgggcacaagauagagagaguccagagaccagauaggcuagguguuuacuucacagacuucuguaagauaagaauguaacacccuguagggcugguaggaaccagugaggcaauggaugcaugaacacacuuugugcagugauccacucauauucuuguuauucuggaugcauuccuaaaacaccuaagaagaugcuuagaugcuguagcccagaagcccaaagaugcaacugagaaaucuaaauuauuucucaauucuugaggaauaaaagaaaaagagggaauauauagaaaaagcuuuuaggauugguaguccagcuucaugcucaaaauggaggucagcugguaccauagugcuuuauucauggcagagagacgguagggggccaguauaaaagauuucauuuugagugccuaugauaaguagauaaauagaagagaaaguaauuaaggucaaaucuucauguaaugguugcugguuaccugcuugcuuauccaaguuucauauacuaaaaugaaagauacuuauauuaacauugaaaaguugauuaugaagauaaauaaguaauuuuauaaaaaauaaaaaauaugaugcuggagagguggcauuggcugcuuuuccagaggacuugguuucaauucucugcaaugacagcucaaaacugucuguaacccaauuccaggggaucugguacccaaaugcagacauacaugcaaucaaaaugccacugcacauaagaaauauuaaaaaaaauuuuuaaaaaucacacaguugguacuuauagcuauacuuauucuuaaucuguaaaaauaaacuccaaagucaccucuuaagcaagucuuccuuuggggcuggagggauggcucagugguuaagagcacuggaugcuuuucuugaggugcugaguucaauucucagcuaucacaugguagcccacaaacauuuauaguaugaucugaugcccucuucuggcaugaaaguauacaugaggaaagaguauguguguguuaaaauaaauaccuauaauaauauauuauauaauaaaaaucuauaauaaguaucuauaauauuuuuuuaaaagaaagucuuucuuuacuguuagggccucucuucuggauuuauguugugccucucuucacucagugcuggcacuugccauuguuguauuauuauguagauccuguaucuuuuccucccauuagucugcauucauuggagggcaaacucgggucuaguauauuuaagagucagcugagugccuuuuuaguuucuaaauauagguuaguaaauaaaacaaauauagucgcuacuguuuauuaaggagauguauaauaaaugaguauaauuaaaaauugugauacuugcugugauaaucaagaguaccuuuugaucauguuaagucugucugugagacaacugccacucugaccaguaccugcagcuuaacagaaguuuagguagcacugacugccggacaagagagcuguuuggugaaaagguuaaaaccuuggugucaucagcaacaagggugguaugugaggccuuugggcuggggaggucacuuggggagaguguauuauaugaguaaaggggucuggagucuuggaauugugaaaaauacugaaggaaguguauacagaggggagaagagaagacagaaagauagcaaagcaagagaauccaagauaguaggguauuuaaaagagaacugaaguuaauuauauugacugcugaugagacauugaacaagcacggaaaagugaccauuagauuuuuuuaagauggaaaugauuggcaaucuugacaagaguacuuuugugaaauaggaagcaugccacuuggcacagaggggaagguaguggagacaguacuucaaauauuaauagauaauucuuuugagaagcucugcuucugagggcaagcaaagauauagugguguuuggaagaggaagauggugucagagaagaguugugugcgcauguguaggguaauguagaguacuugauauauuuuucuaauauuucuugggucagguaaaaggaaucauuuaguuaugauuuugaauuucuuuuuucuuugcuauucuacaucaguuucuaaacucuuuggcucuacuuuuuaagaucaauuuacuuuuguuuuguuuuguuuuuucaggcuggauuucuguguguaguccuggcuguccuagaacucccuuuguagaccaggcuggccucgaacucagagauccuccugcuucuaccuccccaguacugagauuaaaaaugugcaccaccaccacuugguugucaacuaacuaaguucuuaacuacucagccaucucuccaguguuugucaucuuauuucuuuaggucuuaaguguuucuucucgacaaguccuuuccugaccaacccugguuccacacuuacacacacauguguaccaacccugguuccacacuuacacacacauguguaccaacccugguuccacacuuacacacacauguguacuuggcacuguuuaauuucagugcuuacuuuuugucggcaucucuugcuagacacauaauuuaugcaaacauaggaguuuuguuuuacccaacacacacacacacacacacacacacacacacacacacacacacacacaaagaagugguuugcaaauagcacggaaaauuaaggauaaagccuguaggaugagugugaaaagaaaagacagccuccaguuucuuugggucagguaggggcugcaguggcagcuagagaagucucuucaggugauaggcagcuuucuuuuaaggcaaaaggagcuagccaaugacaaauagaacguagaaggguuuuaaucaggagaagaauguuaagaguaggaagguagguagggguguguguguguuuugaaaaagcuguuugugugugaaucaccucugcuggcugcugucacaccgcuguacauaaguacagggcaagacuaagugaauuuuaagucuuuuuguuuguuuuauuuuuuauuuuuucaagacaauauuucucuauguagcccuggcuguccuggaucucacucuguacacuagguuagccuugaacucagagauccacuugccucugcuuccaaagugcugcgauuaaagaugugugcgagccaccacagcccagugaauugucuuuuacuucaaaucucugccauuuucauaucuuuauugccucucauuucuuuuagcuuuaggaagguucucagcauaacccuaugucucaauucugucucaaauuaucauuagugucuaaagagugcuuuuaagauaaucaaaauaauuaagaagguguucaugaaaaguggggaggggacaaaaaaagaagguagucaugcccuuauaaauauuuaaguuagaagguuagguaaauuguauacccugauaaaguucagauuccuuuaaaauaaagauuuggaauugucuggcucuugaggagccuuccaguuuauuccacaaagacagauugucuuagaaagugggcucuugcucauuaccugaggcacuccaugucucuacuggaucaaggccauggagacauagaaauuaaucauaguuuuguccuuugaguuauuccuugccuagugaccacaagaagugaagaugaaacuuggcauugcuucauagaaguaugaauaaaaugcaguuaaguguaguaaaaaauauuuaauaaaauccuggcgugaaguuuuuuucuaccuuagaccacuuguguucccagaugaaagacacauacagccuuauauuuguaaauaugccuuagacagcacaguagcugggcagcugccuacccuccaugcuguuaggauccacuuuccuacugaaaaaucccaguuacuacugacugguuucuauguucccucugggcugcucuuaacuccaauuggccagcccucauggucacguguuuauggcucagccaucccacugcaguccccuccucucuccugcacacacuuccucuuccaagagagacaucuccuuccuccuuccucguaguggucucaagcccugggaaaccuaaaccccaccuaugucucuucuccccagcuauuuaucagucagaauuaacuaggggcagggucccucagugucuuacacucaguguguuacguguacacccuauagucuuuggggcaaacaauuuuaggggacccaaauuagcauuagaauacaagcagcauuaggucaacccucuauaguuacauuuugaaggaggauaaguagaggcuucuuugaagguuucuuagaggaagugaguccaguuggaccuugaggaaugaguaggaguuugcuaggcacauugaggugucuuaggcagauagaaccaugaagguaaagguggagauaugaaaguauacugauugaaugaugguuuggggaaugguauagguaaaacuagaaacagaugaggaagaaacaaauauuuguuggacaucuuuuuguaucaagcagcauguuagguacugucuuuuaaaaagcuuuuguguuuuuucauucuuaugauaacucuaagguagguagucuuguuugcaucuuacauaagagucaacggagcaucagaaaucaaaguagcuuuaaaccaccuacaguuuucuucccugcugccccagcaauugcuuucuuguugcuauacuagagcaaguagcuggcuggagguugcauagugggagugccuuugacgcauuagaaggacaucucucagcaaauucaaggcuacaguauuccagguuccugccaaagcaaaccucuuggcacgauuuaauuaaagaucagauucuaauaaccaggcaccaagggcauacaguacuccucaggcaugaguguuggccaugucaauauugcagcugcucuggguuguucaaaguuagaaauguaguugguauguggaguaggucuuauuucuucuuccuguccuucuuucauuuuguugacuaauuuauuguaaacuucuagcauuucguucccuccuuccuuccuuuuuucccucccucccucccucccucccucccucccucccucccucccucccucccuuccucccucccucucucccucccucccacugugcugggaauugacuugcauacuauucugccacugaacuauauccacaucaccuucccucuuuuauuuaaauagugaucugagggaucuggugaggugguucaguggggaaaggcacuuguuaaaccugaugcacuuaguuuaauccguagaacccaccggugaaaagagaacagacugcuauacaucccccucuggcaugcucaugcauauagugcacaagcaugugagcacaugugcccaacaaacacauguaauaacauuaaaacauuuacauuuaagugaauuagaaguuguguaguauauuccuuuguuucuagagguuaccaugauaugugguacugugaucacacaaauauuuuucaggucuuugcgucuugugcucaccacauacauguuguggauggcuggcaacaucucugaacuaugcuucuuuggauuuguuucauuguucuauucccagcaccuagcagagccuagaaaaaugaugccuaccaaguagauuuccaagcuuuuuauaaauucugaagugugaucugguuacuaaaauaccuguuccaaacaguggcugaaaucuuauauguaaagguaauuuauccagcuuguucuccagggaaacuguuucauaggauuucagcaacucacuugggaaauguaaaggacugucuuguacccuaagccccauauuguaagcucaagacaccccagaauccucagugcaaauggauagcaacugguuucuuccuuuagguaauaccucuuuucucauuguaguuucucuauagcuguguucuuuaaucaacagcuuuuuguuuuguuuuguuuuguuuuuaaaccugacacauuuacuguccagguacagaacugcuuagaaaagucuguuguccccccccccccccccccccccgccagauauaugugaggcaaaaaaacccuuggguuuuuuccuugcuuucucuacuuuauuuacugaggucucuccaugaaccugaagcucaccaauccagcuaguuuagguagcagguuucucuggggucucaucuuuacuccucagguacuggaaaugauuguaaaaacagagaggacuuggauaaaacagagaagaacuuaugcgaaaacucuuuucagaggaggugacuaaagguggaccagcugcuuuugagguuauagauauccuacugguggagaauuucagguauaguugggacaacucagaugccaucaucagguuucagacaauagauuccaguagaguuuugcuuaaucuacccauuaauaauucucuuaaguaugauacagugauuaagaauaaagaaaaauauggugauuuccugguguaauccuguacugugggccuaaugggaguuacauuaaaugaggcugcugguugaaggacuugggaggccagagagagccugguuggguaagguagcuaggagaguauaauuuuggaacuggcagccuagaguaggagggcauugccaguugagacacuggaugcucuuggaagagcuaagggaccugagugggagcuggaggagaaggcaaagcuaaauaucuggggagugaaacuagaagaaaugaaaaagcagccgccuagcuagucaguuccgaugaacacaggcacccuugguuuugauaucguuuguucaaaaaggaaaggagcaauuguuuugucaaagguuggucaagaugaauuaaaauccaguugaagaggcaggcagauuucugaguuccaggacagccagggcuauacagagaaacccugucucaaacaacaaacaguuaagauuuucuuuagugaagagagaaaucauugcauugacauggagccuggcuccuuccccuuccuugcuccuuuucucuuuccagggugauuaagaauauuuaaugauggccagguauacauuuuuaagcuuaauacuuaggaggcagaagcaggcaaaucucugaggguuugaguuuagccugguuuacauagugaguuccagaacacccagaacuauauagugagacucugucucaaaaaacaagaugacaacaacaacaacaacaacaacaacaacaggagaauauuuugugagcuaacaggcaguauagcuuagugauaaugcccagaguuucaccuuuagcacaagaaggaaggaaggggaagagaggggagggaagggaagggaaggaaggaagaaagaaugaauacuuaggaaguucaggacuuuuuagacauaaauugaauguggauacccuuacuuuguaaugccaauugguaucuuacuuaaggacuuugaauuuuaucuguacuaguaaauucaagaccgcauauaucuaucuuucuguaaacuguauauuaacuuguaucuacuauaaguuaaaaagguaaggcacuguugaucugcaaagauggcuccuggaaaagauauaucuguaaacaaauuauaacacuacaaagaaaugugauaaccuggaaauaaacacauugccuuggagcauagagaaagggcaccugccuuuuuggagguuggaacauuuucuaaaggcagcauagaaacaacagaguuaauccucaaaggauggaugaauucacugauaggaaaauaggcagaugaaacagcuugugugaagggauggaggugugaaaguuagggcauauuuaaagaaauuaaagaaguauauagcuauacuguaaagggaauuaaaaggaguggagauacagaaagugagacuggugaaugggccuggucaaauaugagauacguuuucuacuauuucaugaauuaauaaggagaaaauauaagcucuggacacauauuuaucuguugucaagaacaagaacauuuuaaggcacuaaucccuguucuaauuaaaaucacuugucgacauaucaugggguuuuccucuuuuaaauuuuauucuguguucagaggagggauauccagaagaacuggcacaugggcagcaucuuucuugugaaggaccaaaagguuuaagcacuguacauuugugggcguauggucauuauucugccagugugaucugaaagaggguauagguauauguaaaugugugaauguuguuuagucuugguaaagcuagccacaaaaccagaaguuucaccgacacucagccauauagggaaagauaacuuauauaaaguuaucaaguuaaauguugucagcagacucacuguauggagugcugcuggagguuuuaguuaagcuucacggagauggaugaaugggacugaagaagcugugggguuucucaacaucuaguacguguuauuggcuuucccaucgagguuuugucugguccauaucugcuuuucacuuauauuuguucuuuagacucugagggaagagacugcagagaaaaacaaaaucuuggugaauuuuuagcaguguuuggaacacauuagggauuuacaucuggcugacuaaauaggcuagcaguauucaugacaagugcagaauggcuguaugauuuuaauuuuaaaacauuuaaaauauguaauuacuuuuucuaaaaaauaugaguguuauuauuuuuuucuuuugauucuaguagcugcugcugcugguggugacaaugucaaauaacggcguagacauccaggacaaacccccagccccuccgaugagaaacaccagcacuaugauuggagccggcagcaaagacacuggaacccuaaaccacggcuccaaaccucugccuccaaacccagaggagaagaaaaagaaggaccgguuuuaucgauccaucuuaccuggagauaaaaguacaguacuuuguuuauuuuaaucauuuguaugcuuuaagaagaaaaaaaccaaagcaaaucagcuuuuucccuaugaauagucugaauagaagaucuuuccuuccaugacuuaauucuccuucaguaccuuuuauuuucuuguuaacaugucuuccuucuuagaguggcuaaagccaaaugcaaaauugacucauugcucaggauuauauuugaacaaaaauuuaagaauaaauuugcucuugccagcuuucagauaaauugaaaauauuuguaucuauuucuuuuuccuuuuuuaauuuuuaaaaaugcuuaucaaaucauaagaccuaaggacuuuugaagugucuuuggaaacuucuuuuucccagauuacuuucacuuggaaugccaccuuugcaaauuuugaucgccuuauuuuuuugucuagaucuuuggucccauuuucaagauuuaguauuuaguguuaguaagaauaggaagggauaguggaggaaugaugauggagguaaguaggaaucacugugaguucaguaugaguaagacuuacuaggcaaccucauuuccuguuguuuuuaaagucuagaucucacucuguaucccuggcuaaugcaugacguucuccugccuuaacuuccaaguagugauauuacugacauacgccaccaugcuugccuuucauuacccucuuacuaauaaaacuugaaagaauaaucaaaaaucuuaaugaugaaccugaaaaagucacugccaucuuuauagaaaaaaacaguggaaacauaaaaguuugaguguuuccauagaugauuuuuaaaaaagauuuauuuauuuauaauauguaaguacacuuuaguugucuucagacacaccagaagagggcaucagaucucguuauaaaugguugugagccaccaugugguugcugggauuugaacucaggaccucuggaagagcagucagugcucuuaaccacugagccaucucaccagccccccauagauuuuuuuuuuuuuuuuuuugccugauacuaacaaugcuaacuuaggcugggcagugguagcacaugccuuuaauccuagcacucaggaggcugaggcaggcagauuucuuaaguuugaggccagccuggucuaccgagugaauuccaggacauccaggacuacacagagaaacccugucuugagaaagaaaagaaauaaaagcuagcuuagauggcuuugaugacugcugaucuuagggaaagcucccagguauccacguagggcucuuuuuguggugaggcuuucuaucuguggaaggacaagcuucaggauccgauuuaccaccaucaagaaagucacaggguaacagcaaagcaggaggcagcuuucugaaauuauauaucuuaugagaaacuuguauaacaguacagaaagaacuacuacaacuugacuaaaaaucaggcaacucaguuuaaaaauagacaacggaucuguauagacaucucuccaaagaagauagacuaauggaaaacguuguuaucauuaguugccagggaaauacaaauucaaaccacugcacacuaggauggcuguaacaaaagcuggaugauaucaaaugucggugagaauauggaaguauuugagccucucauaauugcugguaggaauguaaaaugguacagccuuagggaacgcauucuggcaguucuuuaggugauuaaguggagagaaaugauacuagccagcauuuucaccaaggagaaauaaugcuuuagccucauuuguuugugauucccaaggaacuaucuaguauuaaaaauaaaauauaacaucgauauaaugaauaauauuuaauuuaaaaaaguaaaguccugagccauacugcaucuaugggugaaccuugaaauaugggguuaaggaaaagaccuaguccuaauggucacauaguguguaguuccauucaugugaaaugucuagaaauguaaauuccuagauuaaaagcauguuagugguugccuacggagacagaguagguaauaaacagaugagauuaagggggugauggcuaagagauaggaaauuucuuuuugaaaugaucaaaaugcauugaauuaugguguuguuugucuggcucugugaaaauacuaaaagcccaauuauacuuuauagguaaauuauaauaguauguaaaugauucucaauaaaauugguguuugugugugcaugcaugugugcgugccugccugucugcuugccugugugguguauaugcauauggguauccuaauguauuccauucuaccuuauucccuugagaaaggucuuuuacugaaguuggaacuagguggacagucagcaagccccagcaauccuccuguuucugcccccccccccaaauccucuacaguggugggauuacagaugcacaugggcauacuuguuuuugaaauggaugcuggcaauuuuaacucuuauucuuauucuuacauuacucacugaacugccacccuagccucuuuuuguuuguuuuuaaagauuucccaucuagaacaggauagaaacagcaccuucauaugucauugcaaccaaaagaguaguuuuacaugcccuaaaucuagauaccuagguuguaaucuugcuucuuucacaagcuggauaucauauuugugucagugacuucucuguagacuuuagugcuuucaucuaaaaaaaugagagccagagcaacagacacaguucuuuuuuagcucugcaacccugaauuuauauagaugagguauugcaaagugucguuggaucagguuuaucuauguagauggaaagaaaccaggacauugugagguauuuuuauugaugaugaagcuguagacuuggaggcucuucuggaaaucucaguuccccuaggccaaauuuggucugaaaaaaaaaaaauaaaucuuuuuuuuuccuuuuuuauugucugccugccugccugccugccugccugccugccugccugccugccugccugccuuccuuccuuaauuccuuucuagacaggguuucucuguguagcccuggcuguccuggaacucacucuguagaccaagcuggacucgaacucagaaauccgccugccucugccucccgagugcugggacuaaaggcgugcgccaccacgcccaguaaaaaaacuaaucuuauccucaagaucaagucugcaucuuugugguugaaaaccuagagguugaaaacagcuacaagaaauuuuuguaagaucuaauagccuguauuuuauuuucuagcuaugaauuuucuauagauucccuuaguacauugguuuuaccccugcuuuaagagcugugucaacugugauuaauauguauauuaagauggaaaaauggcugaguuucuucccuuugcaaucuuaguuucagucagcaaucuuuacuuaacugcaugauauacaucagaacuagcagucuuugacaugcucugccuuuauguaguauuugaggauuagcagaggcugcauagauaacuagucuaaaaaugaacuccacuaaccaugacugagaucugccccucgcaucagcucugucauuaauuauuuuuaaauauuguuauagcaucaccuguaaagugggaguaacaacucacgcccauuuaugucauuaggcauuuguauaccacuuuaugucaugaaaguaaauuauuuucuaaacugcaaagccauacagaugagagguuaacuuaucuuuaugaaaucucauuuauucuuuuaucauuauccaauacccacaaccuauuuccaguaggaaaguugaagcuuagagaauaguaaacaaugcccaaggucucauugguggaaagugagaugaaugaauguagagcuaagucuucccaaagugucuauugcaucuacuccugugcuccuguuaguucuucucauagcagaccauacauggcacucuuaagaaauauguaccuguucccacccagauguuggagacagaauuucuagagaugcaguguugugacucuaaggaaaacgagaaugaaaaguucuuuacagguuacgguagugguuuagacuagagcuggcaguggguggugcugucugugggcauuaccuaaugcugaccuccaggauggccucaguuugcucuugagggaaugcauacaugauuggaaggagaagcuauaauugaaggcuuguaauaggugaugcugaguugcagaauuccaugugggaaggccugguuccugugguuaggauuuggagccuuggguuuauucuaagaagucacauagcauuuaguuugcaaccucuuucuggcugcauuuucaugaccaaagugaaauucccugagcuugggaagagguuggugaaguuaauuuuaauacugaacuacaggaguguuuaucucucuuaaguuuggaauguuuuacugccuuuugcucagauuaguucaguugagccaaugaaacgugcuguuuaaaacgaauuuuaaaaugggguuaauuaaucuugcugaaacuuuaauguuuuugguaaaacaugggauuuuguagucagcugcuuucuccaagcuaagcccaggcugaacuaagacagagauaggagguugcaagcuucuuuucuuauguuauuucuucaaacuuaaggucuuuacuuauaugaaagcaaggcgauucuuucucuuuuccuuucuguccucagucauaucugaguucuuugucuugaucagcuuauugagaacucuuacuucaguaguugcaaauauuaauaauaaaacuuguuuuuaagguucuuuauaaaaccauauauuguaauugauucacagaauaguaaauugugcuguuuuuuucuuuauuucaucccuuuuuuucuuuuugacaccuuuauuacuguguugaauucuaauggugaugaaugucacccuuauuuuguuuuuaauuccaaaggagaggcauccaauauuuuauagcuauauaauguuuuuuagaggcuuuuauaauuaguuuuuauuagguuaaauaaauuuugugaauacuaagaaguuuuaaugauguuggauaucacauuuuagcaaaggcuaaauuaauuauuuaauuuacuauauauacuccccuuuuuccuuuuccuuuuuuacaguucauuuuauuuuauguauauaugugaguaccuacauauguguaugugugugcuuggaauccauggaagccaggagagaguguuagauuuccuggaacuagagcuacagacuguuauuagucaccauaaugagugcugggaacuaaacccaggucuucggaaagagccccaaauauucuaaacugccaagccaucucuuucuuccucccucccucccucccucccucccucccucccucccuccuuccuuccuuccuuccuuccuuccuuccuuccuuccuuccuuccuucccuccucuuugcuucuuuuuaagcuucuauugauuaauggauggugauggugaugaugaugagggggaggaagaggaggaggaggaggaggaagaagaguauuuguuugugucccauggcaucuguguggaggucagagaacaacuuuguggaguugguucuccgcuucuagcacauggguccuagggacugaauucuaggcuuauauggcaagugcuuuacccauugagccaucuuauuggcucuuucuuugccuucuuaauaugguaaauugcauuuacuuaaaaaguugauguauaacuaauaccauauaguucaccaucucagaauauuugauauuuuaguauauuuacaaaauuaaacaggagcuaugaguauaacauaaugguauacauuagcauaaacaugcauaaauaccuauguucauaucucagcaccaaaaauauuuguucaaucauuacaguaucaguacauucuuacuaaaccaaaaagaaauucuauucuuuuuuuuuuuuuuuuuuuugguuuuucgagacaggguuucucuguauagcccuggcuguccuggaacucacuuuguagaccaggcuggcuucaaacucagaaauacaccugccucagacucccaagugcuaggauuaaaggugugcaccaccaccgccuggcagaaauuccauuccuauuaagucagucuucauuugucucuucucucauccucuguagacauauguauuuucagucugaguuugucuguucuagauauuucaauaaauggaauuacaacauaugcuguguuuugugcuuuuuaaaauuuauuuuauuuuuauguguaugaguguuuugccauauauauguaaaccauguauaugucuggugccuguggaggucagaagaggguaugggguguucuggaacuagaguugcagaugggugcugaggaguaaagcuagguccucugcauuaugcuaauugaugcaaguuuucaaaguugucaucugaucugcacaaaaaaugccaaggcauacaggaauacugagacauauuuccaaucuuuccagcccuccucccccagcuucuugcacuuagcauaaugcuuacaaaguucauccauuuuauagcaugaugagggcuucguuucuuuuuaucaguaaacuucauuauaugaaucuuauacaauuuaugcauuuaucaguugauggaauguuuuauuagguucacucaaucacaggcuagagagauggaguuucuggccuuggacuauuaaacuccuaggagcauagauuugcauuauccaguuuuuuucuucaaucccaaaucagaguauaugucuaguaaaagauuacucuuaucaaaguugguugguuuucugguggcaaaauccugagcacuuugcuuccucuaggccuuugcuuacucuguuucuggauuguccaucccugccucugccuagcuaauagcuauuuauccuuaaugauuucuuucagaugguaucuuuuacagaaggguaacucauuguuuacuuuaaucuauauucugagcaguaauugguguccuauaggacuugaaauucagagacuuuucuaggauuucuagagugcaugccaagaugauaagaaauggguauagugcauaaaaccagagacacugaaauuuauagaggagaaagugggaaaaaaccucgaagguaugggcacaggggaaaaaaauuccuaaacagaacagcaauggccugugcuguaagaucaagaaucgacaaaugggaccucauaaaauugcaaagcuucuguagagcaaaagauacugucaauaagacaaaaaggccaccaacagauugggaaagaauuuuuacaaauucuaaaucugauagaauauccaguauguacaaagagcucaagaagcugaacuccagaaacucaaauaaccccauuaaaaaaugagguacagagagagcuaaacaaagaauucucaacugaggaauaccaaaggccugagaagcaccugaaaaaauguucaacauccuuaaucaucagagaaaugcaaaucaaaacaacccugagauuccaccucacaccagucagaauggcuaggaucaaaaauuugggugacagcagauucuggugaggauguggagacagaggaacacuccuccauuguuggugggauugcaagcuuguacaaccacucuggaaaucagucuggcgguuccucagaaaacuggacauaguacuaccggaagauucagcaauaccucuccugggcauauacccagaagauguuccaacugguaauaaggacacaugcuccacuaugcucauagcagcccuauuuauaauagccagaaccuggaaagaacccaggugucccucaauagaggaauggauacagaaaaugugguacauuuacacaauggagacucagcuauuaaaaacaaugaauuuaugaaauucuuagacaaauggauguaucuggaggauauccucuuuagugagguaacucaaucaccaaagaagucacuugauaugcacucacugauaagugaauauuagcccagaaaccuagaauaccuaagauacaauuugcgaaacacaagaaaaucaagaagaaggaagaccaacgcguagauacuucauuccucccuagaauagggaacgaaauacccauggaaggaguuacagagacaaaguuuggagcugugacaaaaggauggaccauccagagacugccccacccggggguccaucccauaaucagcugccaaaugcagacacuauugcauaugccagcaagguuuugcugaaaggaccguguuauagcugucucuugugaggcugugccagugccuggcaaacacagaaguggaugcucacagucaucuauaggauggaacacaggacccccaauggaggagcuagagaaaguacccaaggagcugaaggggucugcaacccuauagguggaacgauaauaugaacuaaccaguacccccagagcuggugucucuagcugcagauguagcagauggccuagucggucaucauugggaagagaggccucuugaucuugcaaacuuuauaugucccaguacagaggaacaccagggccaagaagugggaguggguggguuggggagcagggcagggggaggguaggggacuuuugggauaguauuugaaauguaaaugaagaauauaccaauaaaaauuaaaaaaaaaagaaauggguguaguggcacaugucuuuagucuaggaggcagagacaaguguaucucugagcuccaggccugccugguauacagagcaugacccaggacagccagggcuacacagagcaacuuuaucuugaaaaagugaagaaaaaaaaaaaggauaaauucugaccucaguuuucuuggcuguggaauggagauaauccguguugucugccuugccuccagggcuuguugugaggaggcagugagcucuuuaagaccugugcauauaugaaggagauaguuauuuuuuucaagaagaaaugacagauuuggcuuuuucucuaguucuuucuccuauauuuuugucuuaggaacucuguuugcugcugggguucugccugguagucuaccucaaccugacguacuaccuaggcuaugucggucagcuauauucccaauuccccuucuccuuucucacuuccucuucucaggucugguuuauguuaagcugcuauuucaguuagcaguugcuuucguucaagucagaaaggauuaggauggcacaguggagggaaagacuaucagguagacugaguuuuacuaucaugugcccugggacucaggacaaggcaguuucuuuuucagggaugucuuucuucaggaguaaaaugagaucguuucuaagacuacuuccuaaccauuuccagaguguucuuaaaguaaacucuguguuggguucuguuugagauuuauaaauauaacaaucaugauuauaagccaugacuugguuggauccuuaagaagcuuacauuuuacuucuuaaaauuuucaaggaauugugugagauaaugagugacgagguguaugaugguauaacagaccuuaugccuuggaaauucacagggggagaaguagaagacaaucauuuucugaaagaaaugggacuugagucagucuuuaaaagagaagaaaaagugagcaccaaguaggaggggggagcucugagguguauucagaggcuguaggcagaaaacagacuggcuggaagagguagaguucacuucagaauuaacccugcucucuccaugugguacaugauuucauuucuuugacacucuuuucucuaaaccgcuuucucccucucuuuggaucuuuauuaccauuguaccuucuuggcuuagcauccaugucugggauguuauauacuuuaucaauauacaaugggaaugaauuauaaauaauaagauauauaaauauaacauguuuaaaucuaaauuaaacaauauaauuguaauucucuaaaaccuuuuaagggauuaguuuggaagggauuuagaaauagccauuugaaacagaaagccuuuccaaagcccugccacauguccuauacauucuagcuuagagugagacagacgcaauuauaucauaagucacugcuuaucuggggccaugguguaauccuuagccuucucauucucaaagcagcugcucuagaagggaaauugccaaguuuauaaauagcccaacccuuagcaacuggaguguaggcuagagguucuuuugaaguuacugaggaaaacaaucuuugggaccagaccuggguucaaaucacaccccuugcagcaauauuaauaaauuacucuauguuuuuaucuauacauagguaguaguaguguuuagcuuucuuaaaucagcuugcaguucuuuagcagugguagaguagaaggauguaagggcuuaggcucuuauuucacuugcuugaugaccaggcagaucugugcugcaaucucuuaguuuacaaaugaaaguugaccuucaggccuguggugaucauguacaaaaauauguaugaaauaccuguuaaaaauuauggggugucaucuugggagcaucucaggaacaucuuugagaguacuugccauucuuauuucauagauuauugugaaccauagaagcuagaagggcccuuaagaucaucuuauccaucuccucaccauuuggaugagaaagcagaaagcaaaagacauugugagguagagguaaaaaugacauggacucuagaucuuuucccaacuccccacuuuauagccuauuuuuugcucuauaugcauacuauauauaugcauaccagauagaacuugcccuucacaggagcuuaaugaaaagcuaaaauaaggcuagaaacagaauaauaaucucuuguucuuuuuuuccccccgcagcaaauaaaaagaaggagaaggagcgaccagagauuucucuuccuucagauuuugagcauacaauucauguugguuuugaugcugucacaggggaguuuacgguaaguccuggguguuagucuuagaguuugggcuauaugcuauuagauucaguccuuucuuguuuucuuaaagccucuuucuuugccaguaacuuuucaagaacacuuuccugaucucaaauuucucuuuuaauuuucuugguuugauuguuugcaguauuugaaauugaaaacaaggccuugcacauguuguauaaaggcucuaucaacugaacuacaucaccaacucaaacaaaucucuuaagaggccccauaagagcaaguucuagguggggcacuaaugcaggaauaaaucagacuuggucccuguucugaaggaggaaaagccugguaaagggcagaccucugaaggaagacacauaaaaggagcuuguguaaauuuugagggaccaggaaaauggauaauaaacaguguuauuuuuaucugauauucuuucagggucccccaaauccaugacuuccugaaaacuuuucauguuuuucuuuaagggaaugccagaacagugggcucgcuugcuucaaacaucaaauaucacaaagucagaacagaagaaaaacccacaggcuguucuggauguguuggaauuuuauaacucuaagaagaccuccaauagucagaaguacaugaguuuuacagguaugaagauugugucucugguaaucacagcagaagcucccacgugcuuauggguuagcaagaaaaaagaaagcgccagugugauggcacggucgcuaagaugcauguuuggaagugacaaccaaaaugaagucuuguuugucucuauucugaagcugcauguauuaauuacuguuacauuuauguauuuuuuguggguuggggccaugcaugccauggugagcauuugaagauuagaagacaacuuccaggaguaggcucuuuucccacugugugaauucuugaguuugaacucagguuuucaaacuagguggcaagugcccuuacccacuaagucuccaccauccccuguauauguuaguuuuaaaaaagcaggguauuauauauaccuagacucauauauagacucauaucauauauaguuauaaagcauggacacuaaacugucauuguuguuauuucugauaucauuuuuuaaaaaauuauuuauuuauuauauguaaguacacuguggcugucuucagacacaccagaagagggcaucugaucucauuacagaugguuguaagccaccauguggcugcuaguaauugaacucaggaccucuggaagagcagucagugcucuuaacuucugagccaucucuccagccccugauauuauuuaauaacauuaauaagugucuuuaaguugcaagcccaguuucuuuuuuuuuuuaaagauuuuauuuauuuauuauauauaaguacacugucccugucuucagacacuccagaagagggagucagauuuuguuauagaugguugugagccaccaugugguugcugggauuugaacucuggaccuucggaagagcagucgggugcucuuacccacugagccaucucaccagccugcaagcccaguuucuuaagaaauguuuuuguuuuuguuuuucucuuuuugggcuaguuagggcugguuuaggcuuggaacucaugguaauuuuuuagcaucagccuucagagugauuauagguaugaaccauuauaguguguggaaaggacuagauuuuaucauuugaauggaaaucaggugaguaguaauuauaaauguucuuuaaugcacuuucugcguaagggacuauguuuagaguguuuuuagugguggaauugggauuagacucaggucuucucacacuuagcuccauauauuuucaaguaauaauugccuauaguaaucuuauuuguaucauguccuuccauaccaaagauauuuuuuuuucuaggcuaaaaaugcauuaaaaaccuguaauuuuggaaacuugucuucuuuauaguaucuuaagaauguuaaagcgaagcuggguauuguacacucuccuuaaacuagguagauagauguaauacaggaggguuaggauuaaauauaauucuuuugcuaccuagcaaguucaaggccaaccuuagccaaaugagaauuugucucaaaaacaaacaaaaaccucaaaacagaagccauaacacaacaaaaacaacgggacaauuagaacauacacacacacacacacacacacacacacacacacacacacaugcacauacacacauacauacacacauacauacauacauacauacauacauacacaccaacuccucacuguuugcagauaugaaauaaagagguggccuuuguagugugcuuaaauuagugucaggccuagacucuuaugucuuagucugguguucuuuguuucugcggccuccuucaaaggcagaauuguuggagaaggugagagccaggaugaacuggcugacuuugagaggcgauuuccccagcuaguaucuggcucguaucaaaggguacagaugguuggaugauggacagcagcuucacucacgaugccacaguagugcucaggggaggccaugagucuucccagcagcauuuccuuccucucaucuguccccacugggucugucugucuuuuuccauugaaagauuggaucauucugagaaagagcuggagugagaaguugcuaaguagcuaaguuuucuaguaucaggaaaucggaacuuaauauaagggaauuuaauacagagauaucauauuggaagcugcugucuauguacauguauauagcuauaaggaaguugcauguaugcauaugcauuauugccccgguggacuuuguauaugguucaaauuauagucccuuuaaguauuuaaggaugaguguauauagcuauacacauucauauauuuauauauauggucaucuguguaugcacauuaaaguuauaguuuaaauaauuauuguauuuccacagaaacaauuacauacuuuuguguauuaacauagacacacguauauguacacacauguaugugcucacauaggauuuaaaauuuuaggguuguuaaaggcaagaaccaacucuaagcagguuuuauguuugacauaguuuauuuuuaaugugaucauuccuguuuucuauuuccucuucuuuuguauuguuaauuaaguuauuaccaugucaguuuguguauacucuuaugugacuuaucuccuacagggauugucaaggcaaaaucuuauuauccucauuuuaaagacucaaaaguuaauuaaguuuuagaaaaauuucaacuuauucaugaugcaaaugguauauuuauuuuuauuuacauuuuuuggagacaggauuucauguauucauggauggcuucaaccccagagauccuuuugccuauaccuccugagugcugggaguagagccauuaaaggcaugugccagcacacuagcuuuggaagcguguuuuuaauuuaggcuccuaaacacucuggucucuguuacucacaacucuauuccacccccccaccccccacucuaccccaacacuuaauuuuuuuuuuuuuuuuaauuuugguaguuacuaugguauuugauuuucugugccaguuaauauuagggagaaaguagacuagauuggcaucccacccaagucuuggcucugcugugacacaaacuuauauaacccugcaccaguguuucuugccuuugugaacuucaguuuucucguuuguaaaauaaaauguuugaaagcaccuucuacucuuugcauucugugcuuugaaauucaauuuugaucuauagaaauuauacagucuuuaaaaggagaaauguuuauuaaaauauuauuucauucauauguguacuugcaccuagauuugcuugccuugcauauguguguagucagaggacaauucauucuccucuucuaccaugugaguucuauggauugaacucaggucaucagguguaagugacaagugccuuuaccugcuaagccaucuugcugaccccacuuucuugauuuuguuuguuuuugcuuuuuauggugucagagcauauuuuuaaccauaaugccuaguucucaaaagagcuaggaguguucguuaguggcagugcaguaagauauaguuuuguucuguuaagcugaucccauuuuuguuuucaaagaugauuuuucuagagcuuaaccauuuaguuguuguuguuguuguuuuguuuguuuguuguuuaauuuuuuauuuuaugcguaugaguuuugccugccuauauguuguugcaccguauucaugcauggugccuggggaggcuagaagaugggucagauuuccuggaacuggaguugaaguugguugucacuaccuuggggaugcugggaaccaaacgcuggucaucugcaaaagcagcaaccccccugccccccgacccccuagacaggguuucucuguauagcccuggcuguccuggaacucgcucugaagaccaggcuguccucaaacucagaaauccaccugccccuuccucccaauugcccggcuaacauaucuuaaaaauggcccgggauugaacucaugaccuuuagaagggcagauggugcugauaaccaccacacugagccaucuccccaaccgcagcaaaaacucuuaacugcugaguagucuuucuagggaacaggauaugcucuaagauauugucauaggucaccuugcuuccuacuuuguggauccuuuauguauuauagaaccaaaaagccauacugggcccuuuuaugaauagaacugggaucuuggacuuucuuuagucuugguucuugaugagaaauaugucagauuucauagaaucuuuuucugaaucccauuggugaugaacuggcaaguaaauucguaaaauuuaaagaaccaaauuaaagacaacacuggaucuuuuuuuuuuuuuuuuuggucuuuucaagacaggguuucucuguguagcccuggcuguccuggaacucacucuguagaccaggcuggccucaaacucagaaaucugccugccucugccuccugagugcugggauuaaaggugugcgacaccacgcccagucaacacuggaucuuuuaaacaacuucaacaacuucuccuucuccuucuccuucuccuccuccuccuccuccuccuccuccuccuccuccuccuccuccccuuuuuuuuuuuuuuuuuuuuuuuuugcuaaaauuucuuaugggcacauuucaucaagucugagauaauagugguuacaagaugacaguuacuuuaucacucaguccaucagacugaaauuucuuaaauaaauggugauccuccauugcugguuccucaggcacauguguacuuguguguuuaaaggacacaggacaaccuuggguauauuccucaggcacuguccauguguuuuuuuagaugaggucucucacugagcuggaacucaucaagcagauuggccaggaacccaucucccucugcuucuccagcacugggauuuuaaucauauaccauccauucagguuguuuguuucuuuguuuacauccuuguauuugcacagcaggacuuuacugacugagcuaguucccagccucuaaaagauccuuucuggaagcugaagcugaagcaugauuuauguggguaacauaguguggauuucuugccuuuaucuuagaacguaggaaauauucucacccauugaaaacuugugauguggguacuguuauggcaugguauuuagauuagaucagaauuuagauuuugaaucaucuauuuaaccuguguacaugcugggcaaauuacuuaacuucucucaacucuaaagucuauuaaagugaauauaauaauaauacucagaacccuagugaagauuagagaggaccaugguagguguagugugcuuagcauggcuucuguucacagggccaguugugcuguuacccuucugaagcuggcaaguguuuacucagaucucagcaguagcuauacuuuacuacuaaaucuuucguuucuucuucuuacagauaagucagcugaagauuauaauucuucuaacacuuugguaagucuguguuuccuccauucugaaauaaguggguauggaaguaagguucaggacaguguaguacagacagccuggcuucagcgacacucauuuuggucacugucaugccuuagauucucuaucuacaguaaaggaacuggagugguuaacuguuaucccuguuugacuguagucucuuucagcuuuacagugcuguagaaauucuaaccuugaaaccugagauguagcuuuuaggcuguuucauuugucgguuugaacauuggaaacccaguuugucuuucuguggcucagaguucucaucuguaaaaugagaaugauucauucuuccuuaccuggauguguuucuugacaacugaauuuaggagggaauccuaaaaaaguuaaaagauggcugaagguccaagugagugguagaguaccuguuuaccaugugagaagcugcagguucaauccccagaaugucaggaaauucaaacagaaggugcuguaccauauugauucauuaaacauuuacagaaaccucuauucucugacagguccuuuguguagcagacagacaguguccuauagacuuguaccuccuagucuuauagagcauaugaagacacauacaguuaccgcucauugugcuauaaacccccugaggucagggacuguaucugucuuguuaauagcuuugucuuugguacucagcagguucugacauuugcuaaacauuuauugaauuaaagagugagugugucagugaaagcaucucaacgguaacaucuaugcugaaugaguuaccuagaguaagaauuagagagacgacgaaauuucagauagaaaauuauaugcaugggaaaagagguucacaagguauguauauucugggaacugcuaguaguuugauaugucuggaugugccagaagagagguuggcagugaagaggcauaguaaaguaggccaagucaguaggaguuuggcuuugucuaaaagcuaaugaaaagcuuagaagaauuuuaaacagagugaauaguaauauauaacacaguacugagccgcugucaaacuuugcugccagcgucagaguuauuugugcucuuggcaaguauaaaagguaccagccuaguacuuugcaauguauugaguccuuuuuauucauuaucucuuuuauuuuucacagcaguguaaugaaauagauugcuacccuuguuuuauggaugauaaaacugaacuagagaaagguuaauggcaguacccauaggauuccuacucuguccuccuuucuucucauucaugcugccugcaacaaauggaagagauaaugauuuaaaaaugggggaaguauuugcagauacacugucuuugaaaaaugaauuauugaccaguaaguuauugaagaaaagccuaaacaaaguggaguagugaucuguggguuaaaugucuuuacacuuuuguaaaaagaguggcuguuaucuauuauugaauggccacucuaugccagacauaguguuaagauuuucaucuuuaacauaauuaguccuuacaauuaccuugggaagaaggaacuguuguuuuuacuuccuggacagaaaaacaaaucuuccgaauaacucacaaauaagaaccaaguuagaaaccaguuguggugcaagccuguacucccagcacucgggagguagaggucagaguuucaaggucaucauuggcuacauaguaauuagacuggcuuggguggcaugagacucccaucucaacaaacaaacaagugaccauaaaaccauauaagaauaagaaucuucugagucucacagucuaggguuuuucacugggucagggaacagagaaagacauagaaggacuuauaaagacaaguacagugaggcaacagcucuguuguuagugugggagaagggcccuguggcucaugccauauggcuuagauagagaguaacaccugcuugguuagugucuacaaguagaaccacucacacugucaaggacauuuaccccuaacugagagcauuuccccuauaagucccuguuuuauauuuccuuauuuguauguacauugaugugauuuuauaauuguagcauaucauugauuucucuauugguuucauacauauuguuguauuuaauucauaaaauaauuaagcagaauuacuaucucccuauuacagauuuuaaaaauguggcacagacaaauuaugaauugcucccuccuauugaauuaauaauaaaaaucaguuaaaaaauuccauucucuugaacauucauguauuuacucauuuuauaaguauuuccuuagcaucuuuaugccaaagcacaggcaacacaaaaaguaaugugcacucuccuauaccuugauacaaaucuuaauaguggauuaaggagauaugagccaaaagaauaauaugcaagaauaauaugcaauggugucauguuugauuugugauuuguucuuucugauaguugaaggaaguuuacauacuaaguccuaaagguuugcucauuuaacaaacaugaucuuguagagcucuuucuguucuaaacacucuuaucugugccuaggaucugacucuuaagauucuaugcuauuuuuaucguugauucuuauuuuuagaauucauaccagucagguauguugguacauaucuguaaucuuguucaggagggagaaauaguuccaagcuacuguggacugcauagccugacaccaucuuaaacaagagacuauacauugugugauagguucuuugggugcugagaaaugaaggccugguaagggcuuugcucuuaaucucacaaguuagugauaaaccagaacauauaaaaaggauguauaacauagugucagguaaaacuagguaauaagaaaugggcagugcuuuccugucugagggguaguguaacaaaagccuguuuauuaaggcuguuuauuaagggcucauuaaggguccagaauauaaaauaagagcaauuggaguuugaguaaacuauuuuaaauaaaaugugugugugugugugcauguguguguguguauuuggaugugcauuuuaguguaagcuugagucuuauuccucuucguuuaagaagcuuaggguaaugaacugaauucaugugcucaucuuuuguuagccuaaagauauauuucaagagggauagcauuccaaaacaacaacaacaacaaaaaucaggucauaaccuaaccauugugaagaauucauaaaagacacaaagccuguuaggaggaguucagaagcagcuucaaguaauuggaagccagguacauggcacaugccugaauucuuaguacaggagaugacacuagggauuguggcuagagagagacagagacagacagacagagacagagacagagagacagaccaaacacuaggagauuucuaccacaauguuaagaaagggaaauauagcucugcaguugcaagaaaauacuuguuacuuuuucugauauauuuuauuuauugacaauuucauuuugauacaauguaacaugaucauacucacccucaacuccacuuucuuuuucuguccucucccaggaucuccuaaaaaucuaccucccacuuucaugucuuuuccuuuuuuuuuuuuuuuaaaccugcugagaccaauuagugcugcuugauuagaauguuugauugaucuuguugacuuuagugugucggaaacuacagcugcagugagcucgugaaugcaagugguccaucauauccagcagacagcaugucagagcacuccuccccguccucuagcuuuuacaucuuuuccaccuccucucugcuaugguuccuugagccuuggguaggguagcagguugcuacagagcugaacacucaguggugggugaccuauuuucagaacuuugaacaauucugagucucuguauaacuguugccuacugcagaaagaagggucucuggucaugguugagagaaacacugacccaugaguauaaacguaaauauuuaggaggcaguuugacaacuuguccuuuuagcaaaacaacacaacagcaguaaguccucacuguggucuguggccugaggcaggggcuugugaccagguucacagugccagguggggauuccuuucugagaagaaaauaccuuuaaaauucggcuucucgagaggaggugucucauacuucuuaauacccaggagggagaacuccucccucauaugcuuuuucacgccuaugcuaucuuaaagaaaaacuugucacgaaucacuucucuacaauguacauauuaaaucagaccugccguaaauauauuguuggaauaaucaaaggguaaaagaauucuuaaaauuuaaaaaugcaaucaaucaacaaacauuaaaggacaauuacacacaaaugaaguucagaaaauuaauaggacagauggagaauuugaaaauaaggggcaauaagcacaagucgggaagacaaaucagagaacagggaguagaagagaaaaaccaaauacaacacacacauccucaaaggaaaagaaauacagcagcucccuagguaaagaaaagcauaagucuucagaugaaaggccugucaaccaggccacacaaucagagacuaaagagauagagaaaauucuuaaaagccucuuuaaaaaauugagccagaguagagccaauguagacauuaguaucagacuacuuauuaacugugguagauauaggaauaucuuuauccuuugaggugugaggaaaauuauagagucaaaaaauucuauaccuaauaaaaaucagcauuugaucaugucauaauaaaaacauguuuggauaugugaagaucgaaguuuauaacacacagaucaucuuugaaaggcuaaacauuauauaauaauuaacucacagagaugauggugauuaagaauauucacuuaaaauuuaucauuuuauccaaauuuauauuaaaaaguccaguuguuaguauacaggcauucagcuggccuacucucggggaccuagcaauugcuuacgacaugaccuucuuaccacgugaccuguugcaggucagguacaacaggugugugcugcgaauaaaagggcuugccacuugccugccuccaucauuuuguggguccucacuccucucccuucccccaauaaaccucuuuuacaccagguccuuugcauggcauaauuucccagggguacacgguggcgugggccugccaaagcuacccaccucgcuacauuauauuucauaauaccaguagacuagaaacuaucaaauaacacuauuuccaagacuucucuucaccauugucuuggcaaaccuguuuugguauucuauuuucuguuguuauuauuauuauuacuauuacuauuauuauuaguaguaguaguaguacuacuacuuuugacauuuggugaagcacaugcacugguaguuuugagaaaguaggaaguagauaguuaauaucuuuuaggucuuggaauuggaguuucuauuuccucauauuuuauuaacacuuuugcugauuacagaauucuagguugauaauuuuuuaauagaauuuggaaaauaauauauuuuugucauuuguuuaaaguacuacuaauuccaaagccauuuuuauuuuugcuuuuuuauauguaguuuuuugucacuugaaaaguuuauaggaucucaacuaacgcucuugacuuucaaaauuauguacacauuuucauguuuuauuaugaaaagaacaaauacauuuauuacaaacccuuucaacaugaauacuccagauuucauguacucggaaauauauuugaauuguuuucuuuauuucuucuuucauuuucuucguucucuuuuucuguaacuccauugauuuuuguuuuaauuuuugggauauuuucuuauuuuucauuauacauauuggguuuuauuucuauuacauguuuaauuuccaaaugcaucuucauuuaaaaauuuaauaucguauuuugugucuagaauuaguaucugcucuuaucuuaaagguauuaaugauauacuugauuuugauuuuuuuuccuuccuauucagucugguguguauauguguaugugugugugugugugguuuuuguuuguuuauuuucugggugauacuuguuuuguuuuuucuccuuuauguugaaguuucauauuuaaaaaucuuuggaggucucuuauauuuaugauugcgauacuaaaagcuuaguagaauuuaagcucaauuuaaggucagugauuucagcaacuuacaguuuuauaaccaccuccauaauucagaccauaggauagugcauuaguuuucuguugcuguuauagagcaccauaaccaagcuuacaggacuuacaggaagaaggcuuucuuugggggcuuucagaggcaucggaguacaccaucaucauggcagggaguauggcauccacaggugggcgugacacuagagcggcagcugaaagcucacauuuauaaacaggaaacagagaacauagagguuaugacacuagucuuuugaagccucaaaaccugcccccagugaccuucuucugucaacaaggccacacuuucuaauucuucccaaacaggggacaaggcauuuaaauauaggccagaacauuuagaaaaaucuuucauacuuucuuuuuagaacuuuucuuuuagguucuagguuagacccagagaagaaucuucuaauuuuucuuuguugauaaagaucugacuacaaaaguagcuacgagacuguuucccacaggguugucaucauuuuccaucccaccagcaauuaugaugguucuaauuacccugaccccuucuuguuuucugucucuugauuauagucaucuuggugcaugugaaguaauaucuuauugugguuuuauuugcauguccgaaugaguaauggcuucgagcaucuuuucguugaccauuucuacuguguuuucuagacaaacuucuuuccuacuauuugauaacuuuauguuuuucaaguuuguugagauauguuuucauggccuagcauuucuguuguggaauagugacucauguggugaaauguuuuuucugcauauauggaugggaugugaaggucaaauugaauguuuguguuuucuauaacuucuugggcucuuaauuauugagagcauagaaauggaauccccaagaauaauugaaaucucucuguacaauagaauuauuucuugccuucaacgugucauuucuugcuuuacauaagaugacugguuuuacauaaguauuuuauuuauaaucauauauuguaugauuuuguuuauaauuauuauuucaauuguuuuuacuucuuacacauuaugaaaugaccuucuugauccuaguaauauuucugugucucuguaugucugucugucucucuaccccuuucauuuucucucucucugcugggauuaagcugagggcccuucauaugcuaggcaaguguucuaccucugaggcacaucuccagcaugcuaagguuucuauacaauguuuguuuuaguuacuauaacccacuguacucuuuuaugacuacucuuuuauguacauauauuuucuaguugucuugcuuaaacuuauauaggaaacguauguuuauauuuuguuugcuguuuuucuucuaguguggcaauuucugcucuaugggguauuuagacuauugauauuuaacagaauuauuguguuuggauuuuuucauuugcuuccaguuuuucauaugaaucuuuacuuucucuuaauucuucuucuacugcuuuguguugaaaaaaaauuuuuuuagugugugugcauaugugguauguucauuccugcauguucaugugaaagccagagguugaugccaguuuucuucugucacucucugauuuaugacagcgggucucuuacuaaccauggaguucaacguuaguguuaaacuggauguucagugaaccccuaggguucaccugucuccaccuuguauuucugguguuaagagauacaagaagacaagucuugaugcaggaagacauaccugacugcugguuuguuuuaggucaacuuaauguaagcuagagucauuggagucgaagauucucaauggagaaaaugccucuguaaggcauuuucuuaaucagugacugauggggggauggcccaauguuggcauauuuguuuuaucuguuuuaucauguucucauauaccucuuuuuccuucuccauacuuauccaccacauuuccuucuaaucccccagcacuagguaggggagagagaagguuagagggaaagggaguguagaccuccuuagacuacuuccugcagacuagggacuucuuguuucuuggggcuggcccagucuucaucauuaggauaucuccagcuucucaucagauucuccagcaacaacagcacuuaggaggaagcagcagcugucuucuuuggacuaccucccacccuucucagggcucuugcauuagacugucuccagaguccccagucugcagcuggcaaagaucaugccccccuagagcacagggcaaucauaguuaacgguuguggacaaucugaagcagccccauauuccagaccugagauuaaacaaacaaacaaaaaaauguacagauuacaacugggcuuuuaaagaaaccaagcagcccaggccauuggacugauagauggugaccuccuugggcuggagguccaagaaaacaggcugaccaagccacaaggaacaagccacuaagcagcaucccucgauggccaaugcaucagcuucugcccaguuuugaguucuuguccuguuuuccuuugguaaugaacaaugguuugaagugcaagccaaguaaacccuuucuuccccaaguuccuuuggucaugguguuuuaucacagaagugauaacccuggcuaggagacugccuuuuaacauauugcuggggaucucugggucuugguuuaugcaguaagcacuuuccccagggagcuauccuccaacccuuugaaaaaguacuucuauuauauaagcugggaagguggcuuagccauuugccauuaaagcacugggaccuaaguuuaauucccaugaauacacugcauauauuagaagcccaacaaugcaauauuguagauuuugcuuuauacgaucuuuguuaauaaaaaagcaacaagaaaguggaugcucacagucagcuaauggaugaaucacagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacacgcaaacuuuguaugccccaguacaggggaacgccagggccaaaaagggggaguggguggguaggggaguggggguggguggguaugggggacuuuugguauagcauuggaaauguaaaugagcuaaauaccuaauaaaaaauggagaaaaaaaaagcaacaagauuuguuggguaccuuuaaucuuagcaaucaggaagcagaggcaggcagaucuaugugaguuugaacaucucuggucuacauagcaaguucuaggacagcgagggcuauguagagagaucugucucaaacaaaugaauauauguguauauauuauaucuguauauaacauguauauaauaucauauauaauaugaauuguauauaauaauguuauauuacauucuauauaauauuaacauauauaauauguuauuucuacauaauuuaugcauauaguacauauauaauauacauauguguguauuauguauaaauaaacaauauacuuauuuauaugauacauguuauauauuauauauaauaaaauagcaacaagaaaucuaaaaauguauauuuguugaauauuucuuuuuucuuuuuuaaagauuuauuuauuuauuuaauguaugugaguacacuauugcucucuucagacacaccagaaggaggcaucagaucucaucauggaugguugugagccaccauaugguugcuaguaauugaacucaggaccucuggaagagcagucgggacucuuaacuauugagccaucucuccagcccaaauauuuauuuauauauuuacuauuucuugugcucuucauuuuggcugauggauuugaguuaccauuugauguuauuuugagucuaguagaaugacucucucuguauauaaucauacacacacacacacacacacacacacauaaaaccucacuaguugcaaguaagauaugcuaacauucucugguuuauuuuuuuaaccccaaauguguucaucuuuauuaaauaauuuuauuucuuuaguucuauuugagggggugugcacaugcccauguguguguguugggggcagugguagaggaccauuuucaggagauaguucuuuccuuccacccuuugggucccugagaucaaacucagguugcuggguuccguggcagauguucuuaguuguugauauaucucuccaacccucaucuccauuuuuuaaagguaguuuuauuguauauagauuuugugauuguuaaguuuuuaaaauguuggcucuagauuauaucauccuauugccuucuggucucuguuguuucauuuacauuuuuuuuucuugagauagcaucguauaauguaaccuaccacucuccuuccuuccucuucccuuccccucauuuuuccuccuuuccccucaaauuauauaacucuuguuucacauuuccucauaauauuuuagaggaugauguacugccuaugguggucauaacuuggugcuuauacgugcuugacacugucaaguuuugugcucuauuaugauguguuuuuauuguuugagauugcgcuuucuuuaguguaucaaauguucagucuuucuggauucuucaacuugucacuuguugggauucuuggcuuuccuuucucaggagcuucaggugguaggcaggagagggccucacccucuggcucugucuagugauggugaccuacuucagaacuuggaccaucuuuuuucauuuuuaugccuuugauguugacagaauccaccacaguauucuaggcacucugaaaauaugugaaauuuauguccauuuaucugaaaaauccauauugccuuucugguccuacuacuaaaacaauaacaauaagaacaacuacucauguuuuagauccacuuaucuugagucugguuauuuuugucuagcuuuauuacaguuugcaugggaaaaucaaguugcugcagaucauuugcagaucuaacuaguggugcaguaaaguucauccugaggcaggacugaagcucggggaaacccacagggucugccacagccauacccuauaauauaauagguucaggaguuuggagaaaggaagugggggugcuauuuagacuuuaaguuacuauauuaagaacaaauaaucacagugauaaaguauagaaaauuaaauacuuuuuauuuuccucuuuacacuuauuuucugcucuuuauaaagaguaaaauucacagaauaaggagaaccugaacauggcuuugaguauuugauuguauaaggcagguaaggaaacuauaagcuggcuuacuacucuuuagucuuuagaugggaaaaggaagcuuucagagugaauagauagugauggcuaagagagaaggaagcugucugagugagacagcugacugcacaaagauggagagccuugguugaugaccuuucagaagaggugucagaauugacuaccuucuaaagaacuagcagaccugggaucuggaguucuauguccacuggaccgguugauuuuuguccuuucugcauagaaugugaagacugugucugagaccccagcaguaccaccagugucagaagaugaagaugaugaugacgaugcuaccccaccuccagugauugcuccacgcccagaacacacaaaaucugugagucucuggggaucuugaaggcuauacgauuuauucacauaagggguggcagaagcuagggagguagugguacuaagacuggugcauagggguccauagacuggcacuggugaagucauugaacuacuuuuuuucccccucucaugugaauggucuugauucauagugauccuucugccucacucucccaagugcuaagauuacaggcaugcacuacugugcccagcuggaccacuuucuacaugacuaaagagauguggugugcuuguuauuucaguuauuccuaaaguucucuagguaauugguguuuauaucagucuaaccuugguuuaccuacccuuuucuuuacugguuagguauauagaauggugcauuucacuuucagaauaaaauaaauuauuccaguuucuuaggaagcaguaaauugccagagauuuuauucuuuuguuuuauauuauguaguggucagccucuccagcauuuuugauaauccugaaagaccugggagaguuuauaaauacauuagugcuauuaauaugcuggacauuaggaaugcauuuugaugccagauauugguagugauuucucuuuuaacuuccuuugagguuccugcauuuuagaauagccacacucccuccuucugcacuuugcccacucugcaacuuugccuuuugauuuagcaucauugaauagugaucucccaucugaugauacucugaaauacuacuaauguuuguuuuggcuguuuaguaugagaacuccauaaugaaagaauccucugagacuuaagcucuguguugauuaaaugucuuaauggaaggugcuguggaggaaauucaguuagauggccuaccucuuagccuaagaacuuacaaauagaaucuggauuuccuugucuguaagucacaaaguuaccuuaaggaaaguagccuucuaaaucagugagcugucaauaucucccuagaguguccuguuugugguuugcaggcauauuuauuuaacaguuucucucuaaaucuugaacuccucuaaauagaaaagaaaucuauuuaccuaucagucuauccauccuucuaucuaucuaucuaucuaucuaucuaucuaucuaucuaucuaucucguauuuaaucuauguguuauuuaucuuuuuugguaauauaguuugggcagaaggaucagagagaggucaguaaauauugaauaauauauugauuaauuugcuuuucuuagcauucuucucuaaaauaaauacugcuaaguccuauuuuauagaagaagcaaaugagauuugagucaguagauugaucuauccauaguuacuuaguaaacaaacuccaggguuugagagcagauaauuaaauccaaguccauauugcauuccaaaguagugcacauauuauauauauuguuguguguguaggcaugcacugggaaccagguaaggagaaugguauagagggaacagacagaauaucuuuccucaaggcaauaugauggaaaagcaaagaaaguuuaaguaauugggauauaauuguucuacagguauaagaauaaaaauugagaaauuuacuuugcuagaguagucagaaagccaguccaguugaaagaucugauauguacauuuguuaauucauucuauuuaaacacuuaucugaaugcuugcuuuuuauuggguuagaguuagaggacucagggaggaauaauauguguucuuugucucaguauacccuauagaugaucaaaaaauaauuaugacuuuuuuaaugauaaaaaaaucugauaaauacacaucuucuagaaaaggaagugcagccuggaaguacuugcuucuuaaccuuaguaguauauaguugcuccuuucuuaguaacaucucuccuuugcuuuuguagcaguuacuuucucacuuccuucuucagaaugaguagggcaguguuuugaauagagcuaggcuuaccagggauucucaguaaauauuuguuaaacaaacaaauaaauaggaaauacaaugucuuuaaaagcugagguuugaaugcuuaauaucugcuguucauggccaugucauucacacauguugauuuauuauuaaauaaggugguuauugucacuguuuuauagacagggaaacugaagcacagaggugcgaaguaaacugacugaaguaauucagauaguaauguuggcugagaauuaagcccaggucaucaaguucccaaguuuguuuuaaauuuuaaaacaaaauuauuauauuacuauauccuccugucucuugaugaauaaaaguaguucaugguaagcgcuaaacagcucaagagggauaacuccauaaaaguguuaaguuuugcaaagugacagaggauacaaaugaguuucagcucagaaaaaaagcagaguauugugggugagaaagguuuccaucuaaugauaaaaucuccaaguuuuuacugagagucaccuaguggcuuugaagugauuucagugcuaaggccaucacuaacccuucuuguaaagugagaguaaacgaagguuguuuuacccagggcaaaugggcuggggcucagaagaggaacagugcagauuuuggccuugaagagaagggaugaguggugaaggggagguuccugggauguucuaacuagaacauuuacaagagguuccacuaugcuaacaaagguuggcuuggcuaaaauuucccacugauuaugcagguauauacacgaucugugauugaaccacuuccuguuacuccaacucgggauguggcuacaucuccuauuucuccuacugagaauaacaccacuccgccagaugcuuugacccggaacacggaaaaacagaagaagaagccuaaaaugucugaugaggagaucuuagagaaauuacguaaggacuuuauaucuuucuugagucuucccuuagucugugccugauuaaucauugagauggagugcuacaauaaagaucugaaugcuccugggcuggagagguggcucagcgguuaagagcacugacugcucuuccaaaggucccaaguucaauucccagcaaccacauggugccucacaaccaucuauaaugggaucugaugcccucuucuggugugucugaagacugcaacaguguacccacauaaaauacauaaauaaaucuuuaaaaaaaaaaucuagauccuagguuuaagccaugugccuggcuggcucuguuuaauaccugaacuaugggcuguacugcuuacucaucaucugaccuuucaccccuucauuguuucaccagcucugggugugcauuaccuuaggguagagacauaauaagagagaaugugggcagcucacuuugaggguuaugggcauagcuaaaggcuuuuauuuugagaguagucuagaguauuguauggagaaagauugagguauugacugugucugguggaaaagggugcucuuguugaugcuuucuaacccugaccuaggagaagacagcucugccugccaucaugguuguagaaaaagacgggaagggagaccaauguuuuaucauccuguucugugugacaaaugacaagcaagauaguuucuugaauuuuuaaauuuuauuguaguugcucucugaagauacucagguaauccucauuuaugcaguuaagguuuuuuuuuuagacccaaagaaucuauauccugguccagaucauagagcugcaaaguggcacagcuaagguuagaucaagauguguuuuguaaaaagaacauauugccuauugcaguagguauagguugauuuuuuuauuuucauuuuucuuugagacaggguuucucuguguagcccuggcuguccuggaacucacucuguaaacuaggcuggccucgaacucagaaauccaccugccucugccucccaagugcugggauuaaaggugugcgccaccacugcccagccuaggucgauuuuuauuuucuauuuuauuuuauuuuauuuuauuuuauuuuauuuauguauuuauguauuuauguauguauguauguauguauguauguauguauguauuuauuuauuggcuuaggagaccauugaaaaaggauuugaugugacuggcuugauuaaguuuguaugcucacauugcuuucuaaagcugagguuugugguucuuuaguuuagugguuuccuauuucuugcuaauaauucuuguuuaacuuuuuuguuuguuuguuuguuuaauuuauugucuuuaagaauuguuuuuguagccaggcgugguggcucaugccuuuaaucccagcacucaggaggcagaggcaggcggauuucugaguucgaggccagccuggccuacaaagugaguuccaggauagccagagcuauauacagaaacccuaucucaaaaaaaacaaaaaaacaaaaacaaaaacaaaaaaacaaaaaggaauuguuuuugcuagggcccucauaugaggaaguaaaccacucuuaggcaucuguguaaucacaugcacuccuguccucuaaaccaaauuuuuucccuaaauaguaauacaaugcauuguaagaauauucuggccuggacaauuuccucuguucuuugagucuccuuuccucuucauaccuuuuaaauagugauauuuacauuugauuuguuuuaaauuaaaggauauaauaacauacgugagaaguaccaaauccuagugguugggguaucaguggaaaagcuaguagggcugagagauuuagaacuggacucuggcaccaguugauagaugaguuuggagaaguaucuuucuucuguggguuuuaguuccccgccucuagaauacugcugugagaccuguggccucucaugcuucucuguuuuuuauuuaaaguauccccugcuuaagagcucucuuggcugacuuguacuuacaauaaaagucagcucagacagugccuuucugaagccuuuccggucucuucccuaucccgucagcacucacuacagcaaucacuguauuuuuauagcaccuuccguuugcuugucuuuuccauagauucagccucuugagaguagugacugucuuaaugugccucaucuuucucuuuaucuguagcacucagcauauagucugguauguaauaaaugaauaaauguuaacgaauuaauuuaaaaaugauuagcucuuagaaguuuagaaguggaauaaauuacuauuaaaaagaacacagucaaggauauaauacuuuugguugggauuuauuggggaaaaguuaauugccuggcugguaugcuuuuggggaacuggacacaaaaauuuaucaacuuagggaguuaagaggaucaugggaucuuguguguaucuugagcuggaacaaaaugauucauggucucuguuucuuucaaagggagcauagugagugugggugauccuaagaagaaguacacacgguucgagaagauuggacaaggguuaguagcggcauucuguuucuuuggagaaaugucuuaaaguuguauuuacugacauguaugaacuugcuugguuuugguggugguaguuuuugccucaccuaucuggaaguuugauacuaggaugacuuccaaauuuugcagaauuaugccuuauaugagaaauguacgauuaccuggccuuacuaaaguacuccugcagcaagaguaaacgagucaccuauugucuuagcauaaaaccaguuuuucaaacuauaauuaguuuucuauauuaauccuaucugcccaaguauugagaccuaucaucacuaguaugaaauuuaagguccagaucuauagaguguguaguagugagaagggaucuaauuuucuagcuuggugacagauuuugugacuguuacucuuuaguuucaucuccauaaugcauaugcugucucgcacgauugaacucagcaaaucuuaacugaguucuuguuguguguugaagugugaauauggauaugaaucagacacagucugcccucaaggaucucacaucagcaggagauagaaaggcauauaaagaauuauagaagucagcuuuugucuggaaggaggaggucagaugggacaaagaaaaggggaauagagaaaucgugcaaggagcuuaguggugaacaugaguuguauacaaauauuaaaaucaaacuguaggcuuaugauuuaaugcaaaauuuuagguaaguuauaccucuauaugaaaaguaaaaauaaugagauuucuauggaaauaugucaaaagacaugaaaugucaaagaaacuaaaaaaauuaaguuuggcucauaauagguucuaauuggaacaaaguggucuuuuuuguuuguuuguuuguuuuuuauuuauuggaaaagcauuuuuuuaauuagguauuuucuucauuuacauuuccagugcuaucccaaaagucccccaucccccccccccacccacccacccacucccacuucuuggcccuggcuuucccuuguacugaggcauauaaaguuugcaaguccaaugggccucucuuuccacugauggccgacuaggccaucuucugauacauaugcagcuagagucaagagcuccagggguuacugguuaguucauauuguuguuccaccuauaggguugcagaucccuuuagcuccuuggguacuuucucuagcuccuccauugggggcccugugauccauuuaauagcugacugugagcauccacuucuguguuugcuaggcccuggcauagucucauaagagauagcuauaucaggguccuuucagcaaaaucuuucuaguguaugcaauggugucagcguuuggaggcugauuauaggauggauucccggauaugacagucucuagagaugguccauccuuuugucucaguuccaaacuuugucucuguaacuccuuccauggguguuuggaacaaaguguucuuauuaauucaaacuuuuugucuugauuuucauaagcuaccagaaguuucuaaaaaugcauuaaaggauuguaauauaugggugugggguguuacauuugcacaucauuuuauaguuuauaucuguuauuuacaucgagcuuuuuauuugaucuuuuuagcaacuuuuggcugaagagaugucauuuucccugauccaugugguuuuccuacuagauaauacuuuugugagucuaaacugguaaaagauagcuuacuuuuuuuaaaaagauauuuuauuuacauuucaaaugcuauccugaaaguucccuauacccuccccccgcccugcuccccuacccacccacccccacuucuuggcccugguguuccccuguacuggggcauauaaaguuugcaauaucaaagggccucucuucccaaugauggccgacuaggccaucuucugcuacaucugcagcuagagacacaagcucuggggguauugguuaguucauauuguuguuccacguauaggguugcagaccccuucagcuccuugggugcuuucucuagauagcuuacauuuuugugaagaaauuauuuuaccuaccucaaaaauguagauaaaauuuuguauuuagguaauuaaauugaguaucuaguuaagaauauagcaaaaagguacauggacaaguuucaguaaguuccugcucuugguuugaguuucuuuaucuguaauuggaggauuguggauuuaggacauuucuccuccaaaacauaacuuuaaaaauauagauguacaacaucuaugaaauguucuaugcuuuguuucucuggucugcuagggcuaaggcaagaauggaguauuuauuaagcaccuauauuaauguuacuggauuccauaauuuaagaguauuaaauacuacacugguauaaugaaucaguaccguuauaauuuuugcuuguuucccugucccucccuuuaaaaccugaagacugucaagcugccugcucuuauguguguuugccugagauagaaauaauagagugcuacucagucugcucauuuagcucucuaagccuuuguaacauagaagacacagucccaaaguguuucgccuccgagaccuuaauauauuugcucuaugaucaugguauauaugugguagcuggaaagaugacucagugcuuaagagcaguuuuuguucuugcaaaggccuggguuugguuccuaucaccaacaugguagcuuacaaccauccauaauuccaguugcaagugauccuguucccacuuucugaucucagacaccaggcacacacauggugugcauacauacauguaggcaaaauacuuauacacauaaaaccuaaacauuuuuuaaaaaaagaguggugaguaguagcaggaauacagaggucuauagacaucuguagauauacauucuguaacuaaagaucucauggugaagauggucagacagugaagaaagagcuaccaguaaacauauucuuauuuaauagccaauaucuuaaaauuacacuuuacaugcagguagcugggcucucaaagaguggugguuagggagcugguagcccuuguuucuaaccagaagguguacauacaacuaacuuccuccuaaauuggccuaacuucugugggaagcauaaguuuaggauuugcugagaacaucuuauaaaagaccagaauucaacaugucuacaaguugcauuauauauauauaugacauauaguuuguauagcuacaaguauguauguauuacagauuaccuggacacauacaggauuugugguuuuagguaagauuaggguuuuaguuacuucauauagacaggguuacauuucuaccauucucuacaguaucucucacucuuugugaaacccuuucacaucuucacuacacccaucucuguguuugaguggacauauaaacaucugcaugccugucaggaacuauugguuuuuuuuagggugaaguggaaauaucagauuuuucugaaauuauauauauuuggaaaaguaugugcaguaucauuuuuuuaaaaacugaaaaugcauuuuauucaaaccauaggacucuuuugaucaaacucuuuugauuggcuaugauugaaaaguaugcuuuuaaagugucaggguauccuauaauaaggagggaaaggauucuucagaaguauuuagucuguugcauauagguuggucaaauuuucauaauucuuaaaaauuaguucuauuuuaaaaagauuaauuuguggacacccgacucgccagcaaggaagaugccacaacaggauucuucugcacaccuuuauuggaagagcuugauagcaaaggcaaaagaccccgagccccagaacuggcgcagcuucuauaggccuaggaguggcgugucuauaccugauugguugugcuuucagugccucauuuacauuccccaggauuggugagaaacccuuaugcacaugcgcacauugguuguuuacccgaauuuacaggcuguggccagcgguagcaaacgccauguggcuuuccacauuaauuguagaauagaaucucaaaagcugacuaucaauccuugcagcucucugcuacccucuccuaauuuuuuugaggggaggggucuuguccaucgucuucucuugguuuacugaguugcaggauuacaggcaaauaccaccacaccucacuaguuguagguuggguuuuuguuguuguuuuguuuguuuguuuguuuguuuguuuuuauuuuuuuaagaaaggaucuuauacugcaguacaaguuggccucaaauuugggcaaaccugccucagucuucugaguugcaaggauuauaggcagaugccaccacaacagacccuaguuguaguuuuuaaugugaauuuuaaucaaagauaacacauaaguuuauugcucaauaaauuuucaaaaaguaaauuuuguacauaagcugcauccaggacaauaaggagaacauuacugauauuuuaauaaguaauaguccucuucuccaccucauucugaaauucccauccccgccccucccccccucccccaccccccauccucucacucccaguugaaacuauacaaaaugaaagcaaguucucaaagggaguagacaaaaguagggcaaauuguuguaagaaaugaaugucuuugaacacuuuuguauuuuauggacuuggccuagugguuaucaugaacuaaacucuuacauaugcauggaaguacagcucagaguaaaaacuugcucaagaucagacaaaguaaagguucuagacugcugguuaaaccuuuauucuuuacuaccacauacuaccuuucaaaugugagacuaggagggcugcaaaaaaagauuucuuuuugucucuuuuguuaauguauucccagguugguguaaaggugcauagacaaaugcuaugucauugucuuuugucaaugccuguguuuguuucccuuccuuuccugucuuuucuuucagugcuucaggcacaguguauacugcaauggauguagccacagggcaggagguaaguguucaucaccaacuguuguuauuucuacuucuucagguuuuuguuuaauuuggaguuaauuuuacuccccccccccucuuuuuuuuucuuuucuuuucuuuuuugacucaacgggacaguuguaguuucuuuuuuuaccgggcuaguacuaaauaagagacuaauaugauaagacuuaaaaauuuugcaaaagcuaacaaagcuccacuaaggagaacaguucagagcaggaagaauggacaaaguaagcuagguuguuguauaauugcagguaagagaugauguuguagaaguuaguagauuugagaaguaguuaguuaucagguaucuuuuuaaaaauauuuuuuauuacauauuuuccucaauuacauuuccaaugcuaucccaaaagucccccauacccucccccccacuucccuacccacccauucccauuuuuuuuuuuuuuuuuuuuuuuuuuuggcccuggcguuccccuguacuggggcauauacaguuugcguguccaaugggccucucuuuccagugauggccgacuaggccaucuuuugauacauaugcagcuagagucaagagcuccggggcacugguuaguucauaauguuguuccaccuauagaguugcagaucccuuuagcuccuuggguacuuucucuagcuccuccauugggagcccugugauccauccaauagcugacugugagcauccauuccuguguuugcuaggcccuggcauagucucauaagagacagcuauaucuggguccuuucgauaaaaucuuucuaguguaugcaauggugucagcguuuggaagcugauuaugggguggaucccuggauauggcagucucuagaugguccauccuuucgucucagcuccaaacuuugucucuguaacuccuuccauggguguuuuguucccaauucuaaggaggggcauaguguccacacuucagucuucauucuucuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguuguacuccauuguguaaauguaccacauuuucuguauccauuccucuguugaggggcaucuggguucuuuccagcuucuggcuauuauaaauaaggcugcuaugaacauaguggagcauguguccuucuuaccaguugggacaucuucuggauauaugcccaggagagguauugcuggauccuccgguaguacuaugucaaauuuucugaggaacugcuagacugauuuccagagugguuguacaagccugcagucccaccaacaauggaggaguguuccucuuucuccacauccucacuagcaucugcugucaccugaauuuuugaucuuagccauucugacuggugugagguggaaucucaugguuguuuugauuugcauuucccugaugauuaaggauguugaacauuuuuucaggugcuucucugccauucgguauuccucaggugagaauucuuuguucaguucugagccccauuuuuuaaugggguuauuugauuuucugaaguccaccuuuuugaguucuuuauauauguuggauauuaguccccuaucugauuuaggauagguaaagauccuuucccaaucuguuggugaucuuuuugucuuauugaaggugucuuuugccuugcagaagcuuuggaguuucaugaggucccauuugucaauucucgaucuuacagcacaagccauugcuguucuauucaagaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguuaugccagcaccaauuguugaaaaugcuuucuuucuuccacuggaugguuuuagcucccuugucgaagaucaagugaccauagguguguggguucauuucugggucuucaauucuauuccauuggucuacuugucugucaguaguuaucagguaucuugauagaacuuagugauagguugcgaagacaacuuccagaugguaacucuauuccaguagaaagaauaaagugagagauauaaguaugaagaagguagauacugccugagaaauuuugcugaauugccuaguuauaggagauuuaaacccuugucugucaaccauccaacuauaugcuuuagaucccaauggacacuggacuccucauuuauuuagagguaccuuauuuuauuaagucaugagaaugcugaccuuagcuaaagcccacugacccaagaucagcaaaaggaauccagaaaggcaauaucaagugguugaaugcuuuuuugcagacuacucuuggcuacaaaauaggaauccugauaggugguugcuaccugggauaaaucuuaguuaagaguauuggaacucagaaauugagcaaggaaccuccucuuugagugaaaauaaaguuuuguuccucugagagaggcuucuuggaucuacuuguguaauuuugauuaucaaaaucugguaucuguccuugagggacagcacauauuuuauuggguucuuguuaacuuacaaauguaaaagccaaauauuugauguucugugugagcaagucaauucuuuaaauuaccagugugagaacuggagagaugguucaguaguuaagaauacuugcuacucuugcaaaggacucaaguucaguucccaguacucucauuuggguggcuuaagaacauccuguauuucuaaggggaucuaacaccuucuggccucagcagaugcuacacuccugugcacaaacacgcauggacacaaacaaaauauauauaaucaaaaaauaaaaucuuaaaaaaagucaucauuaucauacuuaaaugaucagagcuguguuagacucuuugguuuugagucguguguauuuugggcugcagaaucccagcagagcuaagguauuaaggacucccuccugcacuguuucuagccucuugggucuuguaacccuugaugggagacacacaugaugagugguuccuggaaguccuggagaugccugugugagagugagcgacaggaaagcuugacuuugcugugugccugucuugugguuauaaaacuaugaauggaagcaaauccauuagaguggcuaaugcaguguggucaggaaggccucguuuccugcccaagggaguauaucgguagugagacuagugugcugcucuuagucuuugugaaugauuaugggguuguuagccagcuggaagaaagggagcuuuugucugucacacauagauggguuagcauguuagugcuuggaaaucuacccauuagaagucaaucauuuucaagcuuguuuuuaaagguaauguguauaauagaaagaacauacuggaagagcuuuggagucauagugaucugagagcauugacugugaucagaggugguuuucuuacaugucguagcuucaaugucuaucuaaacauacaacacuuugaagagugguuagguuuaccuaguaaguaaucuugugaguaucuaagaguuagauaagguaaauacaccagcgaguuccaucgucauucuugcuguucucauagucauugcuggcuucuuuauuaccuauaucuuauaaggaaaaguaacaugacgccuauuuuuuuguacucagaacauaguuugaguagauuauuacuuucaguguaucucugaggagacuuagguucagaaaacgggugauucgucaaauuuagaaaauaacagucaaaaccuaaagcaaagaucuuuaggguuuaaguccaguuauuuuucuuuuauagaagugcuguugccuauccuggauggaucugguuuccuguucuauuuaaauuuuaaaaauuacuuaacuaugaaaucaggcuggucaucaauguacaguucuucucuaucucagccuccugggugcuagaauaauagguaguaccaaguauuuuucuagugacuuuuuaaaagugggguuuuuuuguuuguuuguuuuuuuuacauugagguaucaaauuuugauguauaugugaauagcacuggggcuuauuaaaaguuugugcuuuucaguagguuuugaauggcaccugagaacauuuauuuucagccuuugagacgauguuaaaugccacuggcuaagagacucccuuuaaaaccauuuaacauugauaaguugugaguuacuuucgggguaagaccaugucuuccucaucauuguuuuccuuaguccuuaaggucuaguacuaagccucugcucaggaaauguuguaggacccuuggugcacauugaauuuacuccuguuucagguggccauuaaacagaugaaucuucagcagcagccgaagaaagagcugauuauuaaugagauccuggucaugagggaaaacaaaaacccaaauauugucaacuaccuggacagguauggcauggguggguucugucacagaaguuucaggccuuuggaaccuaaguguuagaggaaaagaugaagguagcaauuggaacugcuucuauuuaauuuuccgugcugagcucuuugauugcuggaaauccuucuaagugaugguuaaccccaccacacugaagcuuuuuagcaacuaauucuuuacuguuucuaaugcuuucugcuaagggaaguuggccuuuucagcccaucuuucugauguccuuauuucauucuauauuccaaguauuuccuuauccugcucaccuuccugaauaauucguauugucuauauacucuuaaaaugcaaugcucacuacagucucggaguuguuuugaaaucugaccaccauggaaagaaugguacucuuugcuuuucugccauucccccagcucaaugucuguuucauugcuaacuacuaguaaguuuguagucaacugaaauugauuaccauucccuccccguauaaacuugcauuaaacuggaaauaaaaaacauuuuagcuuaccagccucaaccuccugacugcugggauuaaugccugcaucaccauuuuuacuauguauguuuagucuucaucaccuuaaaagcuuccucuugagcugggaugugcuuacuauugccgcuuagugauacaaugcuugacuagcgugugugagcucugagcuugguucccagcaccaccagaggaaaauuacagaacaggauuaaaagcuuaccuuuguuugagauaaguguuaaacuaucucagguguccccaucugccaaguaagagucccauuaucaggaugaaggaaagaugacagaucauaccuuaagccaacacguuuuucuccagcagagcuucuuugcugaagguuaccacgagucaguuguccgcuuuuucauuuguauacagugagauuuuuuacuuauccaaaaacuggggcugagagauacagucucugagucaaaaucagugcuaacucaggccaggccacugaaccacagcuuugguuuauuugaagaugcuagaaucacagaaacucaaagaaaaagucauuaucagcauaguaaccuuguguagacuuuacagcuuugaaaagacuuauuaccacccuuucacuuuacauauauauaauauauauaauauauuuauauaauguuaugcuauauuacauuaaaauaauauauauuuaacauauuacuuuacucauagauuuauucaguaaauauugguaucugcugugcuggaccuuggggcuaguaaugaucuuguagauuucagaucuaauagaacucucaaggagguuccauggcccucccuucugaugguaauguggcuuucagaccccuccuuucacauguguguauugccuagaugcuuugcagcaugggaauaaagccagucucuaauuuuaggagauagccucugauauugugauaagaugugauuuuauauuuuaacuuaguauucuuaguuuuaguguuugggacuucacagaccaugguuuuuucugggcuaucccuaaguaacuuaagauuacugauucuguccuccaaauuuuguaguuuuccagaguaaggaauuguagacuguucaaaagcuggaggagauaguuuccuagguuuugaucucacuucaguggcuuaauguguucugacuguuccuucucacccuacacugucuuucugcaguuaccuugugggagaugagcuguggguuguuauggaauacuuggcuggaggcuccuugacagauguggugacagaaaccuguauggaugaaggccagauagcagcugugugccgagagguaaggaaggccaacaaucaaacaggaagugaccuccauauuacuguccaugaaaguucacaccuuaaagagacuucaauaugggcucugugggaguaggggaagcuaguucugggacuuaacauucauauuguaugcuuguguuuuauaauuucuacaaucaugacuuauuucuuugaagcuaacuauucugaccauggcagaaaaauuagaaaauacccaacaguaucuauuuaaacagucauaauuucaaucuacaguuauaacuauucuaacacauauuauuucucuuuauccauuuuuuuuggacauacauuuguccugccucccugauuuguguacugugaaggaaguaacauugguaagaagguaguggcauaguucagauagucagaaaagguuucuuccuugauuugaauaugcaccuaaaugacauguagaggcaagccagcaaaauucuaggauaaaguaacuccagacaaaaagccuggugugcuggcauaugccugucauccuggcacuggagguggaggcaggaagaucagaaguuuaagauaaucuuugauuacagaguaaguuccaggccagcaugagauauaagcaaaccaguaaauaaucaaagacaaaauaaacagaaaaaagaagcauaaauagauacucugucuuuccccccucauuauaaguagauaccuagaggucuguacugcuauaagaagccuuccagaagauucccaugugcagcagugucugcagaggaccggcacauucucacguucccugauaaugugggaaagauagugauggcaauagacaguggugaagauugaggcaggcuuucucugcagagcccuggcuguucuggaacucucucucuguagacaagguugcccucaaacucagagauccgccugcuucugccucccaagugcugggauuaaaggugugcaacaccacuaccuggcccugagagauagaaagcuaggagacugacaaaaagagugagauuaaaaauuuuaugagucugacauagugucugaagguggaaagcuuaaggcauauggaugaaauuauaguuauauauuuagccaguguuaaugagaaagaaauacauuagcaacauuuuaauuccuagcugggauuccuagaaguucauguuucauuuacucuaccacuaauacaaggaccuuuuaaaaauaauucuucccccaaaagcucccccccaucacauucuuaugaaauuuuauuacuacagauacgauggauaauuguguacauacagcugccuuuuggagggucaaagucauuauauuauuuaauuuguuuucuccucuaaccuugaagugcaagccuggugacuugguuucaauccucugaacguuagcacuagcagagaagcaaagccucagagcuguccucugaccuccacagaugcuccacagcggcucccacaccccaaccccugugagggaaauagaaucaaaucuugacagaaacccuuaguuugauccccaaaacuguaccaacaaaaaacuugggaagaaacuacuuaaauaaaugguauuguuauucuuaaaauauaauagagaccauuaucacuuuugaaacugcuuucugagacacaguucauaugccauauaauucauccccuugaaauauauaguucacuguuuuucagcuuauuuucaaagugacuauuaaaggauauggauuuuuuuuuuuaaaaaagcacuugggagcuugagaguauagaccagcagaaaagaguaguguacauaaggcccugaguuugaccaaguauugugccaaagccagaaaaaacauggccaaaaauuuaaacauuauauaauaggugcuauuaucauucuuuaaauuuaaagugaugccucuucugaccuucaugggcaccaaacacguacguacauauauguaugauacacauacacacaugcuggcaaaacucuuucacauaaacuaaauuauauaaaucuuacuaauuuuuuuaagauacugcuuacuuuuaacuaaaaaguucuuuugcauuugugugugugugugugugugugugugugugugugugugcauaugguguguucaugccauggugugcauguggaggucagaggacaacucuaccagguggauuccaggaaucuugcuccggucauaacguuugguggcaaacucuuuuacccacuaagccaucuaucucacuugcccagaaucagacauuuucauuauaccauuguaacauuagucuguuuggcacucauucuguuggauaaguauaaguguuuaaguuuguauguguguauugggggaaucaucacaauagguguuuuguuuuauuuugauuuuuaugguuuccucucucucccucucucccucccucccucccucccucccuuucuuccuucuuucuuucuuucaagauuuuucucauguccuuuaccaauuguaaucauuacuaaaacuuaaaagucuaucggugcuggcucugugggucagugaaagauguaugcuuggugaggccauggucucacuucucagcauuugaaaacaaagcugucuuuguaaauaucucuguauagaacuuaagauaauuucaggugcccaaugaacauuugucuucaugcuucauagcgaugucaaauucagugugucucaaacaauacagacguccuuccccaaaauaaagauugucuacuaaagucacuuccaugggucuccuuuccuagacguagaaauauauuguuaaaauacuucugauuaaagaaaauuauaagacaaaaucagcauccaguuuuuaaauuaauuaauuaaaauuuaacuuguguguguauuugagguggaggguuaagugcacauguauguggaugcccaaggagaccaaaggcauaggauccccucaagugaaggaagaggcaguuuguccacugcccaggauggccacugaggcuucucuucauucuccuuuacccccacccugccucauggaauuuuaaaugcgcaguuaggagucagaagaagauuugguuauauagcuggcuuugccucuuuacauagggcaagucuguuuauuucuggaggccuuacuuccuuugucuuaaaauaacgagguuaaaucauuguuagucuuguguauuauaagucucuuucuucugugcccacuacuucaacagugucuacaagcuuuggaguuucuacauucaaaccaagucauucacagggacaucaagagugacaauauucugcugggaauggauggcucugucaaguuaaguaaguaggagucuuaggagugguaacacuuaacucugcacauggggcuaaaucucuuuugggaugguaauuaaauaauaguaacuauaacagucauuaaauagacuuaaguauuuuguaaaauaugagauauauuucucuguauuauauugugucuuacagugucuuuucacuauuuuuucaauucuuuuacacauuauaacacuucccuccugaaggccuacuucugagguucucugauaggcgcugaggguacauuuuaccagcuuucaagaagcuuucugucuaguaugagagacuuguaaugaauuagaaaaacggauuuauguaacuuuacuuauucuguuauuuauucagcaaauguuuuacaugccagucucuucugggguacagagaagauagucuucacuaucggcucuaucaauuuagauaaauguguagcuucaauauagugugaaugaacuacagguaguuuuuuguacaaaggagugaaagcaguugccgagacagaggcuaugccauaaguggguaaacaguuuaugagaggacuauuggugcagggugaggacuuguuaaaaguagggccauacuuacguguuggugguuggguuuuaauucugagacuuuuguccagaggauaauggaaugaguuaauuauaagacucugaguuauaggaauguuuuuuaaccauuugguuugaggaaaaggcaggaggcuagagauauuguucuuaauauuucuccuacuguucaugguugaaugagcaguggacuaguagcagugagguguguccugcuuuggugagacagagauugcagacaaagccugcugcccauguguaaggacacagcacuuacugauggaguauccuaagugugucuuucuucucccccuuucuagcugacuuuggauucugugcacagauaacuccagagcagagcaaaaggagcaccauggugggaacuccauauuggauggcaccugaaguugugacacgcaaggccuauggacccaagguugacaucuggucccugggcauuauggcaauugaaaugauugagggggagcccccauaccucaaugaaaacccuuugagaguaaguguucucaucuucuugcaaaguauuugggcaacugacucuaauccuaggaaauuguacucaggcucuucucucuguauacccgggcauaguuauacauucuuguacuccuagacuuacaagacugggauaagaagauugccaguuuuugagacaaacuugucucaaaagcaaaaauauggaccugguaagaugacucagugaguuaaggcucuuccugccaagccugaugacuugaguuuaauccagggacauacauggugaaaagagaaccaauuaucacaaccugcccuuugauucccauaugagauauaugguacacaugugcccacacuaaauacauguguauacacuaaauaaauaaguauauauaacaugcauucaacagauacuguugaauuuaaaauauaaaugagccgggugugguggcgcaugccuuuaaucccagcacuugggaggcagaggcaggcggauuucugaguucgaggccagccuggucuacaaagugaguuccaggacagccaaggcuauacagagaaacccugucucgaaaaaccaaaccaaaaaaaaaaaaaaaauuguucugauaauaccaagugauucuagaguagcagaugguaacugcuauggagaaaaaaaauguagaauaagagcaauugacagagugauagggaaggcuuuauuuagaggaacguuuucuuuuauuaguuauuucagcagaaacaugaaggaguuaaaggaguaagccaugagauuuaguuucaugcaaguguuuacagguaucaagaaucccauuugguuuuugccuggaaaaaucaucggaggcuauuauuucccaaaaaggagagaggagaaaguagacugguagccagagucagcaauaagaaagggccagccacuaagucuugugggccagugugagaacuuggcuuuuauuuugcaucauuagaaaggauuuucagcuagauaauaagaggauccagucuguacuugaaaugaaugaaugguuaggcugcuucuuuaggaaauagacaaugagagacuaacaggauaguucagacaagagugguugcuugggucagaauacaggugagaaguagacuugggaagagcugccaggaugcccugaauaguaaagaaguggaaucagcagucaccacggcacgcagugcugacaaguucaguuguccuuuguuacuucucuguuuggucugcugugaugaaaguacugggaccgaggcaaguuacaggagaaaggaauguaugcuuauguuuccaaggggauaagaguucaugauaauaaggaaguggcaaguauguuagcaggaacuggaugcugagagcuucuaucuugaaauacaugugagccagagaacaaacuggaaguagggcaaacaaaaccgagagcucugaaacucugccuccagcaaggccuucauggccaguuaguagauugaugggaacacaugccuaacuugaguaaaacccauaagagcagaaaaggagaaaacugagauggcauuuacaaguguuuucuccucuuacaugaguuuuguuacgaagggugacagggaaauggagcagucucucucuuucuuuguuuuuguuuuuguguuuuguuuuucuucaaaacaggguuucuguauagcccuggcuguccuggagcucucucuguagaccaggcuggccucgaacucagaaauccgucugccucugccucccaagugcugggauuaaagacgugcaccaccacugcccagcagucucuuguagaguugaaaagggucagcuaaaggcuguguguuagcuaguggaagggaauuggugguaaugggagaagaaauagaguauacaauaaagaugcaaggaaggcggugacuucgauuguggacaaauaggaauaggaaguuacuuuguuuuuacuuucucacuuaguucaucuuccuaucuagugcaggaauuccccuguaagaauaucuacgcuuaacuacaugcucagaucacccuuggauaguuccaguugcuggaaagugcuucauugucucaaaaggaaacuuucuucucuaguuucgacuuuauugucccagcuuugcucucucacuccacauguaacacaaccuccucugccucagauaugaagguaaucaguguggugugguggaaauaaaacugaauuagagucagcacgugcacucagaacagugaaugcaacggcuggagagccuuacaugugaaaugggaauaaccauuuugccccaccucugaguuacuguggucacuuaaaaugaguguagcugggugugguagugcacaccuuuaaucccagcacuagaagucagaggcaggcaaaucuccuauguucaaggccagcgagggcuauacagagaaacccuguccugaaaaacaaagcaaacaaacaagagugagagauggggagagagagcgagagcgagcuuuguaauuaaagagcuuaguguuuaugaagguuuacuauuacuguuuuucuucucccaagagcugcuucauauuagagcagggaagcagcagcgaaaccguugcugucucgccaagcauggcuuuuuccucuuggguggaagccucagcagcacauuucugccaacaacuaaacaaagggacguuuaccuugccgugcuaagugaagaauaaacccuuagguuuguaacaccucauacguuuacaaagugcuuuccaaaugcacgcuaaagacauuuuuguggcuauauaaagcauuauauagcaaagaaguuauauguuaggugcauauauacagucauaugacugugaaugucaagccugauuagguuaguauguucucuucaggacauccccgcugaucagagcugugugucagagcacacagaagcuggcuguauuuuagagaacgugucucgauaguaacagaaagaaccucagggagagcaccacgugacucuucauuuguauugcuaggccuuguaccucauugcuaccaaugggacgccagagcuucagaacccagagaaguugucagcuauuuuccgggacuuccugaaccgcugucuugagauggauguggagaagagaggcucagcuaaagagcugcugcagguaacuguccuucugcagggaggugccuacccaaaccuuuucaucucauuuuugucugcguuugcugauuuuaggcuucuuuccuaccauuucacuuuguauuucuagcucccugucacucuugggcuuugccaagucugcccucuguuccucacccuauaucccccucccccaagucccuggucuccaagaggauguccccguccccaccccaccagaccuccccacucacuggggccucaaaucucuugaggguuaggugcaucuucucugacugagucuagacccugcaguccucugcuguauaugugucuggggccucauaucaccugcuguaugcuuccugguugguggcucagugugugagagcucucuguggguccagguuaauagauacugcuggucuuccuauugggggucgcccuucucagcuucuuucaguuauuuccuaauucaaccacaaggguucucagcuucuguccauugauugggcauaaauauccgaaucugacucagcugcuuggugugccucuuggagggcagucaugauaggcuucuguuuguaagcacaccauagcaucaguaauacuguaaucaggccuuggagccuccucuugagcuggaucccaaauugggccugucgcuggaccuccuuucccucaggcucuucuccauuuuugucccugcuguucuuucagacaggaacaauucugggucagaauuuuugacugugggauagcaacaccaucccuccacuugauguccugucuuucuacugggaguagauucuacuaguucccucuucccacuguagggcauuucaucugaaguuccauccuuugaguccuaagagucucucucaccucccaggucucuggugcauucuagaggguaccccccaccuccuaccuccugggauugccuguuuacauucuuucugcuggcccucagggcuuuaguccugucuccccccacccccaauacccgaucauguuuccccuuuucccuccuugucccuuuuuccacccagguuccuccccucccucugugucgccccacccccacccccugugauugcuuucuucuucucccaaguaggauugaggcauccucacuugggcccuuccccuuguuaaccuccuugaguucgguggauuguauccugguauucuguacuuuuuuggcaaauauccacuuauuagugaguacauaccaugcauguccuuuugggucugaguuacuucacucaggaugauauuuucucauucuguccauuugccugcaaaacucaugauguccuucuuaauacuuaauugcugaguaguauuccauugugaaaaugaaccacauuuucugugucucuucuuccauuguggaucaucuggguuguuuccagcuucuggcuaucacaaauaaggccacuaugaacaugugcuccuguggcauggugggacaucuuuuggguauaugaccaagagugguauaacugggucuucaaguagaucuauuuccaauuuucugaggaaccuccugauugauuuccagaguaguuguaccaguuaucccaccagcaauggaggaguguuccucuuucucaacauccucgccaacaugugcuguuaucugaguuuuuuaucuuagccauucugauugguguaagguggaaucucaggguuguuuugauuugcauuucccuaaucacuaaggauuuugaacauuucuuuaaguguuucucggccauucgagauuccucuguugugaauucucuguuuagcucuauaccccauuuuuugauuggguuguuugguuuuuuggagauagcuucuugaguucuuuauauauuuuggauauuagcccucuauuggaugugggguuaaugaagauuuuucccaaucuccuuaacuugucaguguuaucugguaaacguucaaauccuagacuuuucagaaacuuuaaucaugaaguuucauaucugcuucuccugugagaacauauggauagaaagauauaggaagagauauuggaauucauauauuuaagcuuuauccaugaucauccauaguucucaguuccucuguguauccucacucugucccaaugaaacuugaaucaacuuucagcaaagagugucucuguauauaucuccaugugagugucuguacacauacauaauaaugcuaacuauaggaauuauaagaaugauaaaagaaugagauguguuaaguaauuacaaaccucacauuugcucagacaaggaaauuuagcucugaucuuuauuaucaaauggaagaaagaaucuauaucuucaagauaaauguaaaaaacaaaaaucaaacccccaaaacaauccaccaguuuaaguaagagacucugaguuacauaaaaaauuauuuccuauaacauuuucauaugauauuuuucucuuaaauaauuuuuuaaauuggaaguauggcucaaaguacauuacaauguaacauuguaaaggaccuuaaaguccuuacuggaauacuucgccuugcuggagucaaagagugaacaaaagauucuuagccacauauggugcaugcuuauaguuccagcuaacaggucgagggcuggaguuuaagacgaaagauaggugucuucuccagaaagaauaguuacucuguuguugccagaggugaauuuuacccaggaacaaacaaaaccauguaaaaugaacuucuugucuuacuucuuucacucaaaaugucuguggauccauugugcuuucaguguguuaguuacugugcuaauauucuauauaauggcauaugacuauggaacuauuaauuuuuugagcuuuuuuuuuucuuacaguuaaugacuuacaaauaaaacuuguauacuuggucaaugagauaacuuacuggguaugagcaccugcugccaagucugacaacuugaggacaauuuuccuguaccuguagucgugaaaagaauuccuucuugcaaauggaccuacacacacaugcacaucauggcauggaugcaccccccccacacacacacaaaaggauaaauaaacaagucaauucaaggaugaucugucacugaggcccuuacugucugguaauagcugcuauguaagaauggcaaacacucaacucauuugguuuuuucuucuucuagcaucaguuccugaagauugccaagccccucucuagccugacuccacugauugcugcagcaaaagaggcaaccaagaacaaucacugaaaccacgcucaucccagccucaugugccaagccuucuaugaaauaaacacuuguuucaggaacuccgaccccucauguccucuucuccuuuccuugcuucucccauuuccugaucuagugcucccaagacuuugauccuuggaaacugucuagcacugaagagaauugcaacuggacgaguaauccagcagaggccauuucuaaauaggaauucccuuccaguuugugggcauggagggaacugaugagcaaggguuuacccgaauaaaccuguuucuacgaaacagaaucucagccaucccauuccuuaccccucacaaucaguucuuaacuauauaaacuuuugguuugauagcauuaucgauuugagaucaguugaaauugcuuuacuuuuuuauuucugugacuaaauugccugaacaccucauuguauuugaaaaccauaacagcuuugaaaugccacggggccugauaaucugccagggacaggaagaggcucuguuucccgaaccaugcccuuggugcagcugauccugacaugggagaacgaccauguuuuucuuugugugugcuucuagcagcuguuuuggagaaccaugacccaguaguguucccugugcuauuucuagugaaauggucuuagcuauguagcagcuuuugauucccugcauccccuaggcugcugcuugcauucuguccuuauuuauagcauugagagauuuccuagagcacaugcugaguaagagaagugugagaagucagagggaaagugcagcuacuuuuagcacauggcuggcuucagcaccuguccggcuauacuugugugauauuucaagaucucagccucuguuucuaccugggacucagaucuucugguagcuuaacuauuucagucgaaagagaaggucucuaaauccgagaugaugugcuacuaguaauaaggggacccuguuuuuaagugcaugaccaagcucucugcaaguggacaugcuuacucucugcaaauggacgcguauugcggguguuugcuaccuccugcccuccucaugguuuugguucuccugcugugguaggaugcuuggccagcauuguggcuugucaugccagccccauugccuaccuugucaugcucagagguccuacugccucagcagcacaaguuucuauuuccuucaauaaaaggagaugaaaauauucua

SEQ ID NO: 12133 - RNA, 71001 nt, Mus musculus
gucuggugacaacagaucaacuuuaauucuagcaccugaagcuauacaaggguccacuuuauaaacuucauggggcuguuguacacauucaauaaagugaccacugugcaauaccacugagucucaaaaucaggagcgcacuucgaauugcuuaaacacaauccacagaguuaaaaacaaagucagaagccauccacaguuacacuaauugucaaguagagguuuuacacguaauacuugauauaacagucaauaucuagcggggacacugaacgugacuucgcacucucguccuguugcguucuguugggaagguuuucugauuauuggccaccaguggauguaaaaaggaccaagccagcaagcaaaagccauggucucuuugucaguuaacagugaacagugagacuuaaauacucaucuuuacauauacacaagguggaagcauauccgcuuacaaacauauaaaaauacuuguuaacuaguuugauaagaaaauaacguauaaaaguauauagcaaaaacauuaaucaucucugacuuuggaaagaucaauuccauauuuuauauuacaucaaacaaaaacagcuuuagcuuguguggguuuucuuuuuuaaucccuuaaccaggaauacuugagaaggaagacaagacaggaaccauccacucuuacccuuaccacggcugugaaaagauagcgaguucaccaaaacacccaagugcagaaccaguccaaacauuuggccacagagaauauugucaucuugaaggaagcaugauaacaaaggcuuaaucagcaguuuuuaauccauaaauacaacaggcauuuugguauuuuggccacuggaaaaacaaaagccguagcaucaggaaaggucugagaugucucacuuguguugauuccauucaguguauuuaagguuaaugaaaguugacaaccaaaguuuuaaagauaggcaaaaauucacauuuaaaaaaacaacaacaacaaaaaaaaaaccuucccuauauuucuauuuagaguaacaguaggcaacaugauuccagaaguuaaaaauuacuuuccaaccuaugacuucagcuuagcaaacagcucaggcuccaaacuugguuuaccucuauuaaaagcccuugaagacugcaucuguguguguagacauguguuuuaaaggaaucagauaacgucugaagcagccuuaguguuuccuuuacacaagucuggguaagaccguuacauuagcuucacauaaaggauuugccagcuucuugguguaaggcuaacacggugaucaucggucuaaggcuacaaagguaccggaugauguaaacgguagcagagaugagggcuucccuggcaguuguuagcuaaaccucaagggacucuuagaaaaugacacaauggcagccuuucuugucuuuuucuuuccggguugguucuggugaaggagggcauucuugcucuugaaauuuccuguaagacagagaaauccgaauagcaucaccacuaguaaucucccaacacaugcaggucccuucuggacaggcugcacugaaaugcacucacuucucaguguuccacuagaacagugguucuuaaccguccuaguucuacaacccuuuacacaaugguucucaacagguaggucaugacaucuuggggggagguugucacauaucagacauccuguaugucauagauuuacauuacaauuccuaacagcagcaaaauuacacuuauaaaguagcaacaaaaauaauguuaugguugggggucaccauaacaugaggaacugcauuaaagggucacagcauuaggaagguugagaagcacguauuuaacacaguuccucaugucgugauggccccaaacauaaaauuacuucauaacuguuauuuugcuacugcuaugagucauaaacauaaauaucuguguuuucugauggucuuagacgaccacugugaaagagucauuugaacccuaaagaggaugcaccccacuggcugaaaacugcuacaccaggggaugagagcaaacccuuggaaaguccucagaggagcaggggaagcucaggggucugccgagcaugugugaggcccucacaagaaugaagagacgugcagacugcuuuccuggucaagccugaaucaaugccucuauagucucuuccuaaguugaaauuccuggacugaaagauaugcuuagcaauaagcaugcaucaucagggacaauggaaaacuaccucuuacagaugcacauaauuaauuaccccucuucucugccacuuaaacaacaaccacaacaaaaaucaauacuagacaaguuaguugguucugacucuuuaguuuuuacaugggaauaauaaaaaccuaccccuucacaacgguccugagggcuuaagauuccgugguguuuaaaaauaaaaucuucacaccuagcugauugacaggugagaaucugggauucuugagagucaaagggaaauauggguauuugauuaagguaguaauuauuuucacaaagaaacugccucauagguuaaucauugaaacggaaauggggugggggagggcugggaagcaaagccccccaggucaacacuguuaaguuacgguucucuacuuaaccaccgucacugccgguccaucuacaucaagaacguuuccauccugcagagcugaaacucaucaaaaacuaaaccuuacagccucuuccuuccccucucacggagacacacaaugaaccagggcccauucaauauacccaucaaggcuaucuaacuagcagggagagccaggagaugggaaggggggugggggggugggggaagaggccacaggaaaccacagucuagucaugagcagcuuauccugggcuacaugcacagcagaccuuaccugccaccucaagccgcugacuguccacgaggagaacuccuaggccaccuaucaaaacaccucuuuauagacugaguguuugcaucugugucuuaguggggcaaacacccaagacaugauggagucucugcugcuuggcuugcccugagccuggcagggauuuggcaggaacuaggaauuugagauuuggauggguucaagucccacagcuuaacagacauagagacugaacaaguuauuucaguuguccguaccguuucucaccugaaagggagaguaaagaaagcauccagcuuucuggguugucguaaggauccaacguacuaacuugaaaagaaugucacucaguaucugacagggacuugauuaguggcugucaucacuaccgucaaagcauuuacuauuuucaaauuccuugcauguacuuuccucuucaacuucagacaaaugagauuuuuauggguuggaaaugccuagaauacaccauguauuuaacugaaauguaacccacaauguggaccagccccuacuucaaucacuccuccuuccaauuccgucuuucucacuacacaagcugcacggucaucuauuaaaaacacacacacguagcacauguucugcuuaccuuauaacccggacaaguucguggaaagcuuggucuacauucauccugaucuuugccgaugccuccauauaugugaccuugagcugccuugcuaacugcugcccuucuuccuguguuaccugaaacggacggcagcaguuguguuuaaggcacaguauuagcaaccccacuggaccacaucuaagccuggcuacagacauauguugcuacugcgccacccggaguccaggcugacuuauuguaaggaauagacagaugccacagugccacacucuaugaagcccaccucugcacagcucagaagacugcaccuauaauaccaacagaguuggccugcaauguccaugggcucagccaacuguaagucuaaaacacuugggcugagcuagauguguuaguggaaggaacaucaggaauucagggccauccuuggcuacauagcaaauugagaauaccagagacucuguccccaaaauaaaauaaauccaacuccugggcugaaugguaacuagagugagcauauucaucuuuaaccuggccauuaucccuaaacaauacagaacgaguguuuacauagcauuuaugccacauuagauauuauaagaaauacagauuuuuuucaaauauacaggagaauaagcaaagguuauauacaaauucucugcuuccguuuaaaagggacuuuuauacaucuaaagauucuggugucuaugggggguccuggaaccagccccuauugcuaucaaaggacauccuguaaugcucaagguuuaaucuggagaugacaccagaaacagaugugaugguaaaggaaaagaaaacagaaagugcugaaacugugccuaucaaggggucagagagagccugacugaggcagugaucuaagaacuaaauagagucucuagcuaagugucagcagaguaagaaaauagccauggccaaaaaaagguguguguggggaagagggggauacuggugggagacgaccuuaagaggaaucagcuuggcuagcucaggcuagaauuuaaaaauggacauaggcuucucaggccacaggaccuccuuguuguccuggccaguaccugguacacaggaagcaucaggauguggggagggguggcaaguaggaguguuaaacaggaccacggcuguggaagaagacagacagacagacagacagagagaaugggggaggaaagaagcaagcaagcagggauaaaaaggcaaggcaaaugccauuaauuaucacuaacccgcuguauuuuaaacacaaagaauccuaaaagcaguacuucccuaaaguuauuaugcaguauuuguuuauauuugcauaagccccagagcuuuaagcugagguuugcuggugcacacaucucacugcugucuucagaguaaacgcuggagaaaaguuggaaagucagacaugaagagcacuugagacccacuuccccucccaaauaucacaaccuucuguucucucuucaacuauuaaagccuguucacaguaagaaugcagucauaacuuguauauauuucaaacucuggcacaugcugaaguuaucugaguuucuggacacucaggagccuuucccacgcugcuuugcacauuccucucuggcugcucuggggucucugcgcuggccagcagcacccacccucuacacaagcaguggcaggcagugagagugugcuccugacuuguguggucuggggucaaggcacucacucugccuccuaccguucaguugucagcuguaggauuuuauuaaaaacuguccuuuaucuaauuaacaaaauuuucaaccauccuucuuauaaagagaauuauugaaaacaaacguuaagauguuaucaaauguuuuuuuuuucucucucuauugagauaauggugugauuuuucguuuuugguguguugacaugauaaauugugaugguuuguuuccacuccugaaauaaacucuucugggcacacugucuacuguuaaaauuugauuuacuaacguuucguuaagaauuuuuacauguaugcucggcagagagaauggacugugauuuuuuuuccuaucugucugauuuugguuucagaguaauccuggcuucauacaacaagcaagaaagaguucucacaucuucaauauucaggaaaaguuugauaccaggacuauaccuuccuuaaaaguuuaggauaggccaccagugaguccaucuggcuaaugcuuuacacacauacugacuugcccucccuuccuucuuuuucaauggaacucaaaccuagagcugcacaugcauucguuaaguucaugucugguugguagguagguagcuagacagaugcagacacacacacagacaugaucucuuuauggcuggaggcuugccaguuuggucuaccuuacaaaagccauuuggguuuuuacuuauuccuauaguuuuuuuuuauacuccucuucuuuguggacaaugggccuugcccacaccaaauacacauucuaccaccggcccaguuucucugccucucuucccuccuaacuaugguuuaaucuguuguuuuucuuuucuaauauaccuagugacacagcaucucuuguagcagcccacaaaucuugacacucuguguuuaagugaaaccucauuuaaaauucuuuguaauccuuuaauuuuuuuccuuuaaguguuagaaauuugcuugggaguuuggagcuguccucguauguuauugauguccguaucaaugccgcugucaccagaauguguuaucugaggggauguuuccuucagauuuguugaggcuuguuucaugagccauucucugaccugaugcagacucugugcuguuggguggaaagaauguucaucaggggucaguuggacaagcugcucggugguccuacguaaguaagcugucuacacaucacuuuuucuuucuauuucucucugaaagucuuuaagucuuacuucaggacuuuugaagcuguuuugaggccuaggaauggcuaggaccaguaaguccucuuggugaguuagucucugugacugugaaacagcuuucuuuacccugguaaugcacugguucuaagauauacuucacagcuaucucuauggccacuuuaucuucaguguuggcagcacgggauaccuuagcccauccuucuaucguaacuaggcgaugucuuuaagcugcagggccuugcuucuucauucagucugacaccauuugccuuuccauugagagccugaagaccugcucucuuccacucuuuguucugugcacgccccucuccugccuuuuagguuaagaacgacuuuaccuugccuuuucauucccccauuggcugauucacuucaugucugcuaggcuaccucaguggcuucauugucuacuuuguaacugcacauacucgaugaagucaaaccgguuugcacacagccugaggcccggacagugcucugucuuccugcucuucucugguguuacuagcuuuuacuucacauuauuuuauuuuugccucaaacauuuaauuauacuugaaagagguuuaaauaacgucauuuauauuugcccacguaacugccagguccuguguuccucauuccucugugcugacucagacucucauuggggucauuaucucucagcugaggaccucucugcauauuucugauuauccagguccacuggugcugaacucuuacacuucuuacgucuuuuacuugacuugauuuuuaaagcaaguaucugcugggcauugguuucuagauaccaggauuuugcugucaguguguaaguuaugucaucuucuggcucacaucauuuccagugagaaacaacauggaugucaccuguauuagcuacuguacacauugauguaucagguacuucauacacugcugggauaaaaaccccuaacacacgaaucuuaauuagcucauagcuucagaguacaguccauuaggacaggaaagucauaggggcaagagcuggucacaugacuccacaaucaggaagcagagauugauaaaugccucuguucagcucauuuuucucauuuuuaggaaauccagguccccagcccauggaaugauggcacccauaaucaccuuucaguuaacucaguuaguuaaucccucucagaaaugcucaggggcuaaccuaauguagauaaacccucacaggcacagcccacgguuacccuaauccaaguagucccucaugacauccccagaggccugucuccuccugucaaacugacagccaauauuaacucugcacccugaauucugccccucugcaugcaguuuuguguuucuuaacuacuucucagauuuuuuuuuuugcuaauguagaucauuaagaguuuuauuaugaccagucuuauaauugucuaacuauugcuugugcugaggguuugcugagcaucauggauguguucagugcaguuuccaccaaacuuggaacucugcggccaguauacuucuacaaucaguagcaucuggugcaauugucaucucauuagcuugggcuucuggaggcuugacugggaucucuguauacagcccacaucacuucuaccucaugcagacgguguuucuauagccucguauuguuggaagagaguggacaucuguucagugucucucuacugaguccaguguuucuauaacuccuggguuucgugacuggucuucauaacaggagcugugcuuuggucuuuauuuacgugaucucuuucuaaguacauacaugggauuuaaagccccauuccccaaacccugaaaccauucacuacuguaaggcccaaggcuacuuccugugguccaugcccugcugcagcucaacagaggagcacacaggucccacaguauugucccacagcaacaguuauaugauguuuuaauuuuccuggccuuccuucaaaauaacaugccugcccuaaggcuaugagguugaaauacauaccagauucuucaaucaaguaagaguaaguuagaaaguaggcuucauaggacagcuugugaagaaagaaagguuucuguacugagaaaaccaguuauggcagaucccuuccuacccgaagaaaaaacuucauguagucacagauucucucucuuccuacaauagucuccauuuucugucuaaaguaggaguguguguguguguguguguguguguguguguguguguauguguguguguguguguguacauguagagaccaaaggucucaguugacuguccuccuccaccacucuucuccuuauuuuauggcacauggucucucacuaagucaguuucagcugcuugcuuuguucucuccaguacacaccugagcuugccagcagauacauaauucaggucugugcacacacuuugggagaaagaucaauucagagaagcuuacuccaagcuggugacucacacuuuuaggugacagaaaugugacugauuaccuagguugcuucucauacuccugguuuuuauuucucugagaggccaucacauuuuuacugacaaguacuuuuuauaaucccgugacauauaaacagacaagugcuacaauauguugaauaccugcagacagauggaaacuacaugcuucauacuggcaaucuuuaguauauagauaacuuuaaaauaacuaacaccgggccagcaagauggcucagcagguaaaggugcuugcugugccagccuuaggauugcaguucaaucccuggaacccauguaagguagaggagagaaacagcuuccaaaagcugucuccugaucgccacaaggaugcuguagcaugugagccaacacauauuacacacaaugauaauaauaauaauaauuuuaaaaacacauguagaccacauccguggcuaauaaaugagaucuguugcuuccagggggucugucuccccucaacugcucccaccugcuccagagacauccacacaucccaugguucucuuccguucuuucaguggaauuuccacauuugagaaagaacuugcuucuacaaugggggcaggcagcagcgaggggugggcagaagugaguacgagguggggagcagagcccuucucugcauguggcuuugugacccucucaccccccagcagagcaaguccuagaacacacaaagaagagcagcagagaggcccccugggcagcagauaauagauguaauuauguucauaugcgaagacauggagacaacaaacacccaauuguacacuuugcacugauggcuauagagauucuuucucagcaaugcaacuuuguaauaauucaaaucagaaagaggccuaacaggaacauuuauucuccacuaauagcaucaagacacuuucugaguuuuagcgugagaccaaguauauccugccuguagucuacaugcuacaggccucccagaucagccaccaacacaguccaguccaucuguagaugacagcugcacauagaaaugccaacaagcugaacaccacugcccaucauguguaggcuaaucauccccucaugucugaaauccaguaugcuugcaaaauaguuuacagggguugggagauggaucagugguucagaacacuugcugcucuuccauaggaccagacuacuucccaguacccacaucagguggcucacacccaucuccagccccugaggauccaaugccuucacucaugugcacacauccacauguagccacacgcauacauaguuaaaaaaaauaauaaaaauccuaaaaucuguuggacaacuacagcuccacaucaauucauuuuccugaugucuauacuuagccaacaaaaucuuaagacuauuaacagcagcugguaacauggcucagcagguaaaggcacuugccacauaagucuggcaaccugaacugaucccagguaacgguggaaggagugaacugaccccaaagucguccucagaccuucacacacacacucuggcuugaacacacagacucuaaugcacacauacacacacaugcacacacucucuauguacaaacauaaucacuuaaaaaaaacaacaacaacaauagcaaaguaaagagaaucuguuaacaucagauuacaugaaaacaagagaaaacgcuagcaagagagacaauuucaaugcuagguucuagaugugggacagagacucuaagaaaacacgagaggaacuccccagcaguacggguagcacuaacuuacagcugguuccguucugaaaagagauggucgacaauacacaacaaaacaguuucaaagaaacuaauacuaacagucacuagcauuaaagcuggccaauguagagcaaagaaaauucaguuauuaauuaaacugaagaaaaauccaaaaccagguacgguggugcauuccuauaaucccagaaggccaaggcugggggauuucccuuuugagaucagccugggcuacaaacuccagguggggggaauaguucuacuuacuauuacacacacacacacacacacacacacacacacugcagccauuccuuaauuaaagguaauuguggaucagcagugaauaaauuaggcauguguaagucuuuagauuauauaaugugaccuaagcaugguggcuuaggccuaugaugucaucacuugggaggcugagacaaagaaucaaaaccagccugggccacacaggaagaccauaccucaaaacaauagaaagggaaguggagaagaagacauaaugaaaugaaaauucuucauaggaguuugacaaauuaaaucaugguuugcuuucucucucucucucucucucucucucucucucgacuuaaagaagaaagcugauuaaauuuucuucaaaaaacagagauggggaaggggaggagaggggaggggacgggaagaggacaaaaaauuaucuuaacuuauaguuuuuagcuguuauccaagaaaucacaggagccuggcacuaauacaaacacacacagacuuauauagagagcuuucugggauuccguguaaaaauaaugaaaaccuaauucccccccaaacuuucuucacacuucacacaugccauucugugcgaccuagugugccagacucagcagcgagcuggugcugugcugcaccgcacgugugugugugugugugugugugugugugugugugcgcgcacgcgcgcgcgcgccacacaagaguuucuuggacgcggguccuccacucuuucaucaagugcuucuuuacacagcuucccgagcucagaacugccuccuccucaccugucucugaugguccaggucagcuuuauugccaauuaaaaucaugggaaacucaucacgguccuuuacucugagaaucugucuuugaaacuuauagauuucuucaaaacuaaaaaacaaaauaaauacauuaugcuaagaaacuaaagguagugaguuuuauauuguuuauuacuguauugccauuuuucuacuguaaaaaaaaugaaaauuuuaauuccauaaaauagcaaucuggacagaaccuagcacugcuaacuugagguuuuuauuagcaauauuauauugauuccauauaauaguugguuucuauaugacacuuucacacgugcauacgaugauuuuuuuuuuugaucauauuguccccgacacauuaacugcaccgaccugccucuauccgugacugagaagaccaacaggaagcccucgccuguccucauguauugcucucucauggcuccaaacuccucuuguccggcuguauccaaaacuaaagaaaaacaacaaagcaaacgguguaguugcgcauuauaaaucaucucucacaagggcagcccccaccagguccucaacagagccuccuauuugaugugagaggcaaugcauuccugucuuaauauuucauuccuagcaccagaggcagacauaaucuucuaauggcagacaguuucagaguuuaucuucaucgcacagauugauuuuguagcuagaauauauuagcauaccaauuacaagguuaaaaauaucaaacacauccaagcagauggaaccaaaucaacucuaaagucacuugguuauuuaucuucuccauguacagaucucagaaaagaugucuguaagcucaaucaagaaacuggggcuggggcuggagagauggcucagugaucaagggcacuggcugcucuuccagggacccagguucuguucccaacaccuacauaggucuuaacugcuuauuacuccaguucugggggaucugaaacccucaugguuuccuuggcauaugguacacauacauacauacauacauacauacauacagaaaauccaugcacagaaaaauaaaccuuaaaaacaacuaugucuuaucucugugugucuguguccaucugucuguguauguuugucucuuugcacaugugucugucucucugucucuguguguuuguauaugucuaugucucuuugucugugugugccucugucuugguguguaugugugucugucugucucuguguguauacaucucuguguuucucucuccauacuuagcucagccacuaauguauuucuugaucuuccugcuaguuaaaauggcaggguuuucuuuaguggggagagacuguuacuguuaaagucucuaagcuauaaauucccccauuaaguggcuaugggcacuuccccuacuuuaacauuugccaaaugacaugaauugcugagaccugauauuucuuccaacugccccaauaaacaaacuucaagaaguuacaguaacaagaucaguuucaccagaacuuuccaucugcugaagaauaucugaauuguccaauacacagacgcaccuaccagacugaugacagugaauaaguggccagggcuagcucggagggagagaccuugccaagcaugugcaaggccugcuguuugaaccccagaguuaauaaaagguuuauauuaagauuaucuaauaguucaguuguacuacuuaaccugaggaacaucaaaugcaacacuugaaagccagagcauuuuagaaauaaggugugagcaagcuaucagggguuuacuuacuguccagccgggcagcucggucaucgaucacacauugcuuuguguaugagucuucaaugguuggaucauaguccgucacaaaauaggacugguaagacaaacaaacaaaagccccauuuaaaauuccauaucacaugccuuccuaccuaacacuaucaguuuuauugaauucugauuuucaagaaauaauauauuuuaguuguaucagguuaucauaaagauuuuauuuuuaauuauguguacaugcaaaccugugcauauuaagugcagguaugcacagagaccaaaagagggcaucggaucuccuggagcuugaguuccaggcaguucuuagccacccgcugugggugcuaggagcagaauucugauccucugcauggacaggcacagagugcacacuccuaaccaccgagcugcugcucccgcacacacacacagugcacacuccuaaccaccgagcugcuguuccagcccacaguguacauuccuaaccacugagccugcucccgcacacacagugcacacuccuaaccaccgagcugcugcucuagcccacagugcacacuccuaaccacugagccugcucccgcacacacacacacagugcacacuccuaaccaccgagcugcugcucuagcccacaguguacauuccuaaccacugagccugcucccgcacacacacacagugcacacuccuaaccaccgagcugcugcucccgcacacacagugcacacuccuaaccaccaagcugcugcucccgcacacacagugcacacuccuaaccacugagccugcucccgcacacacacagugcacacuccuaaccaccgagcugcugcuccagcccacaguguacauuccuaaccacugagccugcucccacacacacagugcacacuccuaaccaccgagcugcugcuccagcccacagugcacacuccuaaccaccgagccugcucccgcacacacacacagugcacacuccuaaccaccgagcugcugcuccagccuacaguguacauuccuaaccacugagccugcucccgcacacacagugcacacuccuaaccaccgagcugcugcucuagcccacagugcacacuccuaaccacugagccugcucccgcacacacacacagugcacacuccuaaccaccgagcugcugcucuagcccacaguguacauuccuaaccacugagccugcucccgcacacacacacagugcacacuccuaaccaccgagcugcugcucccgcacacacagugcacacuccuaaccaccaagcugcugcucccgcacacacagugcacacuccuaaccacugagccugcucccgcacacacacagugcacacuccuaaccaccgagcugcugcuccagcccacaguguacauuccuaaccacugagccugcucccacacacacagugcacacuccuaaccaccgagcugcugcuccagcccacaguguacauuccuaaccacugagccugcuccagcacacacacagugcacacuccuaaccaccgagcugcugcucccgcacacacagugcacacuccuaaccaccgagcugcugcucuagccccugcaucgguuuucaguucugucagcugcacaacagucuccucagcgcacuguucaaguaaagagaagcuacuaaaugucuuaacuuuccccuucuagaguaugcagaaagauagcaaaagaucuauuacauccccccaauuguuuaguacuaaguaucuaggagaauuagaaacuguaauucagaccuacucagauuugguaagcaccaguuguaagaaccaaaacagauaaggauggagauggcaggaagacggagcgugcuugaagagacuggcgugaagacugcaugcaccauccacggcaaucaugugcuuucacugagaucucuggguaccuuuuccuuaaauuauauuucucuuuauaugaaagccuuccaacuggcaucuucaagacugaguaauuaaggaaucacaauuuccucuuaagauuaaagaagucaggcacaguggcucagaccucccagcacucgguaggcagaggcagguaaaucucuaugaauucaaggccagccuggucuaaauaauacagggcuacagagggagucccugagauagacagacagacagacagacagacaaagauggauggaugauuagauagaugaaugauacauaaguaaaugggaaagcaagcuccuaacauugcucacuucucaggaagggcauggaagggacauugacaucaucccuucucaagaucccuuggcuuugccaaggcugacguccuugggcuacuuucccacuggcuugaaggaguaguuuguuccacagagaagccugugacaaaggaauuagccacuccucaggcaaggguuccuggaagcaggcaguguaguucuagggacacaauucuuaaguagcacaucucaguguggccaccuaagcucagaaagcaacucaucaagcaaaguguaaaagagagagagaucgagagacgagacgagacgagacgagaagaggggaggggaggggagaggggaggaggggggagggaagagaggggagaggggagaagaggggagggggagagaggaggagaugggggagaggggaggagaggggagggggagaggggaggagaugggggagaggggaggagaggggagggggagaggggaggagaggggggagaggggaggagaggggaggagaagggagaggagaggagaagagaggggaggggaggggagggggaaggggggagaggggaggagaagggagagaggaggagaggggaagagaagggagagaggaggagaggguagaggagaggggaggggagggggaggggagggggagggagaggggaggagaagagaggggaggggaggggagggggaaggggggagaggggaggagaagggagagaggaggagaggggaagagaagggagaggggaggagaggggaggagaggggaggggaagggagaggggagggggaaggggaaggggaaggggaaggggaaggggaaggggaaggggaaggggaaggggaaggggaaggggaaggggaaggggagaggagaggagaggagaggagaggagaggagaggagacacuggccugccugcuacugugcuuugcauacuuauuuuauuuuggaaagaaauguuucacauuucauuuauauuuuaggaguagccuuaaauguggagucauuacccauaauucuauuuccuuccugacacauucauuuaaagacaugagcuauuaaacaaagccagcaaugagccacgugccgacagcaguagcuuuuaguaggaagcggcuccgucaccacccugucugcaugucaaacagguaugagaaugauccugagcaggcuugcuggcacucucucuucucagagugaccacagcagcaccuggcagccucucugcugugcucuacccgacaugaccucagucugaacagauaaagcaagcugcuuauacuugcaggggaacggggcgggaggugagggaccaguuucccaugguagggucucacguagcccaggguuaccuugaacuccuaauaauccugccuauacaucaagcauuagcuuacagaugugcaccuacaccugacucaugaugaauuucucagguguuuccucacagcaaucugaugcuuccugccugaaucucaugacuccuucccuuugcaguacaaggauaaaacugagcucuguuuguaugcccgacaagggcccggcuaccccacuucacuccuccaucuaaaaacacagcgaaggaauaagugaacacguacuugacacguugcuuaaguuaugugcuagcucuucaaacaucaguguucugugagacuaaaugaaggcagcggcaugugcugcuguugguuuacaggcccuugaaggccacagcaauuguuugauuuuccuuuuagugccugcacaaguuugcuuugaaggauaauuucuagaacacacucuuaauauuuuaagauugccacuuuccuaucugcucauuaaacacaucugcccacauauuuuuuucaucuuaguguuaguagaguauacauacaugcacacacauguucuguauuuccacauacaauguauuuguccaccucuaucacccucugccuaccccuuuugagucagucucucccugaaccuacaacucccagguuugugacuagaacagcaaccagauagcauuggcuaccucaugucccuauacccucagcguuggaguguacagcacacauagcuuguuccacggaugcugccguccuaacucuaagccucaaccuuguguaggaagcagucuuaauugcugagccccuucucuggcccaccacuuacacuaaucuccagcauaagccugcugcagcggugcgcuugccucagcuacauauguaguucuaggccagucugggaugcagaagacccugccuuuaaaaaacaauagagcugguugugguacacaggcacacaccagggagccagagaaagguguaucucgguuaguuugaagucagccugaucuacaaagugaguuccaggauggccagggcaguuaugcagagaaacccugccucaaaaacaaacaaacaaaugauugaauaaauaacuauagauaacaaauaaagaaagaaagaauaaaaaacaacacuugaacuuagaaacaaugagccagugggguuaccaauaaaacacaguuucuauggcuggagagauggcucagggguuaagaccaccugcugcuccucagaaggccugcauucaguucccagcacccgcauggccaugugggaucccaugcccauuucuggccuucauggggcacugcauguacaugguguguagacauaccugcaggauaaaccuuauacacauaaaauaaaaauaaaucuuuauuuuaaagagaagaaagucuccggcaaaguugaguuuaacucucacugcuacuuccaagcugcaggaucugaagccaauguccaggccggcccuucagcacucgcagcaaagagacaacacugaggcaggagcaggccuaccaaaccagggaucaaggagugcaggcaggcugcugcucuucagccacaaccguaacugggcugcugucaccggcagccacacgcugaaccaauggcuuuccucaaaguccagagcuguguuccucuguggugggggagggaaggcagcucuaacaacuccaggcccaguuaccccacagacccugcaugagccucuggaaugugugccugagugcuaugaacccaguguucugaguucauaacagucugaguguucagcucccauccgggcuucugaaaauauccucagggucugagcaguaauuacacagauaaacacacaggcaugaaucuaucuuguucauuuagcauuuguguauuuguauguguaaagauuacaaccauaaaacguacaaauggcaaucgcucuccucuuccuccuuagaacccacgguuuguguuuguuuguuuguugauugauuguguguuuggagugcuggggacugaaacugcaaucagaucagaucaggcacgguuccaacaccgagccacauccccgcccuccucuuugauuucugagacucagucuugcuaagcugcccagacaggucuugagcuuacaauccuuccacuucagucuccuacagagcugaaacaaguguguaccucaggggacccguaguuaguugcuuuccacagaacacaaaacuuuccaguuugauuugugccucauuucccacuaccagaaccccuccuguaauuuuccuacaauguuuguuugaaguuauaucaguaauaugggugauacccacucuguaccccuuaacaggucccacugucccuuugacagaacacccaaucuacuguuaggaacaacggggcuguggcuuggugguagagcgcuugccagacaugcuuaggucaauuccuaacagcaacaaaacaguaagaaggauagagacaggccaaccccaaaacacaugaaguguaaaaccaugccugcucagaaggcaacacaaauuaagagguauggcugccacuaugcaugggaacuguguucacagagccccaguaacuguccaaggaaaaacaaacaaacaaacccuccagcagcagauaacauggaggcugggggacagcacuagaaagcggaaagcaggguagaccaaaagcuacagaagggaggguggguuuccuggggcuuugccggcagcacauuaaaggauauguggaggggaguccuggcgagaacaaaggacagggagaccacccacacuggauaaguuauuccacuugcgcagagagaucuacugccuucccccauacgaucuggucuggguaaauuugucugcaauagcuacaaaaugguacgcccaggugagcaggcacgcuuccauagccucagucugcgaacucucugcuuggccuccaaagaggacuacucacuggcagcaggcuugguggagcaggaaaauggggaagaggugacaagaaugaauugcccuuccgcauuccaaggggcaguggcgacaaccacuuucucuuaaagccagcccggugugaaagugcaguucccaaacacugccacaggguggagucugguccacaccggagacuagggauccagcacuuggguuaagucucacgggccuggugaggaaagggggcuggaucagagggacuacaggacagggcaaacacaagccugagcauuucugagcccaugccacacucgggaggcuuggcagcuuuuaaaaggacacagugaauaaggaaggguauaauaauaaauuuuaaaaaaaaaaguaaaaaaucucucaaaguaucagauauugaaaggcacagguguguuacauggacaacagaacuacuacauguaucugacagauuccacccuaauuuuuuuuaaaaaaaaaaaugcaaacugagccgggcgugauggcgcaugccuuuaaucccagcacucgggaggcagaggcaagcggauuucugaguucgaggccagccuggucuacaaagugagcuccaggacagccagggcuauacagagaaacccugucucgaaaaaacaaaaaaaaaaaaaaaaaaaaacaacaacaaaaaaaugcaaacuguaaaagcuacagaguuagauuugggaagacaggggugggggugggggauucugcagaagugggagggagggcaagaucgguuaaugggagugaauacgaucaaaaugaguagcuaucacuuagucauuauuguauaauucauacaugcuaauaaaaugaagagaacugcauagucaaaucgagaagcuaaggguucaugcccucauccugagcugaccucaggaaacuuucuaggccuccuccuucuuucucccucuucccugcuccugcccucucucagcuacacacguacauuaaaaaacaaacaaacaaacaaacaaaaacaaaacaaaacaaaacaaacaaaaaaaaaaccuuaaaucauccauuccuucccccacccagccagaauguaagcaggguaaagacaggaacacugccagagaggaaggagaaggccuuccccagcaaaucacaggccaggcaagaccugcaggcagugcggcugcgcaucugccuugcuuauuacucaguagauuuucucauuuauccucacaaggacccuccaacagauuccccccuuuuacaaacauuuuuacaucagagaacugcacuacuucuucaaggccacucaauaaacaagcaggaagacuacgguuuaaauucagacccaaugcuaauaaggucaucagagccuaagaauuauuauuuaauaaaaauucacugaauaccaaauuuucuauuggccuauaaaauaaggaagaauauuuccaaaaauaugagaaaaggcaagauuuauaaacccacaccccugucaucuucuugagguccugcccaguucucuugggaggggauucugaaacagucuagaugcaaaguccuuaagagccuacccugaacacugaaauucagcauggcccuacagacacuuuuacccacagaacaaguuuuacauuucccuaugacaaaauagagcagaaccugagauuugguagcugcuugguuucuugauuagaggauuuauaaaggcuggcugcaggcagcaaggcgagacgaugcaugauuaugcagucaggggauugaaagucaaguccagaagccacgcuggacagaugccugagcccuuaggcgaacugaauaacucugcaagggcggaagagguggcugagcagguaagagcacuugcuacucuugcagaggaccagcguucaguuugcagcacccacguggugguggcucacaaccaucuguaacucuuguuccaagggaucaaaagucuguccuccugaagcaccagggacaaaugcagcgcccauacacacggauagcaaagcguucaggcccggaaaauacauaaauaaaucuugcuuuuaaaaaggauaagguaggcauaacccaaagucuacuuuaaauguggcaagaaggaagauaaccuccuagauaagaggugcaaggacccauucccucuuccaaggaacagaaguccacaccguugccccugggaaucaggcugccagucucgagugaccaccauguccucuauucuccccacccagugugggacacgcuggcugaguuuccccaccucugucccguguguguguguguguguguguguguguguguguguguguguguaggcagcggagagaagcagaaagagacugaggguaaauuagcucuguuuguccuccauguaggaaaccacacagcucgugugcgucugaaccucagcuuccuugccuaugagacagaaaaaaaacaaacaaaaaaccucacugccuuggggggaggggggggcacguguacagagcacaacacaugacacacaguaggccuauuaaauuacagugcauauaccccacacucucacgggaaaaugaucacauguucccaugccagccucuuccccuggggcugacggggcagcucugugguaaagcgcuugccuagagugcacaaggugcaagguuccagccaugcccacaaagaaggcucuuaaccuucaaaaaaaaaaaaucuuacuuucucaccuaggauccuguaaacaaccuaaugaaacucacugagucauaaaaauaaaaucuacaggcaaauaaagagggacuagguaggaagagaaauagagucaguagaaggagaguaauggggcauaucugauuauauguguguguguguguguguguguguguguauguauguauguauguauguguauauauauauguguauauauauaauuagcauguaauuaacaccuaccuguuuacccguuuucagagccaugagguagacugaguaaaacucagugucucucuuguuaccucacuuccccuuuucacaaaugugcacgugggacauguauaaauaaauaaccccgcugggcuuuacauguaaacuucucccuaggcccuucuacaaguugcuccuugcuccugaacagaauccaagagagcacacauugucuucacucuguaacuaguaucuucuucaagugguuuucaggaacuuucuaauuucaacauucaaugcaccucuuccggugucucgaucauauuugccggcacucaccuggcaaccccccacccagccccgccucaguaaaacacggguggccaaggcagcacuguccuuuauuaugcaucucuccugcuccacaccaacauuaucucuggcuccuggguaggaacugaaggagagcauagagucaaagaccacaccaaucaacuuugauguucuuucucaugaaugccuguggguuuccugggagagucccuagaauggggugugugacauaaaauucucaggcucuagagaaaccuacuuacaacucucaacccugaaucaaagaggcuuucaugggucccuccuggugcaagucgucaucugucaguuagccaucagugcguggcgucccuguauagguggcuuugugugggcuccacccagcagucaggacauccaggcagcucaccuugcagcuucuuccguucccuccacuccacccucuugcacuauggaucugcagauucccagccugaucagcgugugcacccacaaggccaagcucucagaggacugcuagaggucccaccauuuggccuacauaaagagaacuucaaaggcaacccaagggucagagccaagaugacucagugguaaaacuccauagcuuccagcgggucugauuuugauccucagucacucuggugacucacaacuaccccuagggguauaacuccaacaaccccaagggcagcaguucucaaccuugggguggggggguuccuccaaaccaccuucucacagggucaccuaagacuauaggaaaacacugguauuuacauuacgauucauuaaaaguaacaaaauuauaguuaugagguaacaacaaaaauaauuuuaggguugggggucagccacagcauuaggaagguugagaaccaguacucuaggggauccgacacccucuucuuggccucaagagagaacugggagacacacacacacaaacgcacaugcacaugugcacgcaugcacacacacaaaugcacacacacacggaagaagucucucguguacucccuagaaauggaaagaaggcaccuagaacacaucgcagcucucugcaagcuuucuuauuagaacccugaacuuugaacacuuccuuggagaugagugugaccuaagcgugcgauguccuuggaaugaggagaauggggcaccacaagcuuuauucuccaucuuugggacuucaauaaaauuaaacagauuuuuguuccaguuuaaaaaaaucccaccaugaacuccccgggccaggcagcucuagaccugacacuccauagcacagcucacacaccuuacuuccccauaguaagggccuugccaucuuggacacagccacaaucucaaaauacggcgguggggaaagccaucagugauggggagccaggaacccacuucccugagcuggugaggacacuuagccaucagcagucucuagucacuaaacaaaugcagugggaauuccucuggagacaccagcaccucagccacaggcagcugugggcagagcagccuccuguaguagucucucuguagcagcagcugucagggcacagagaaccuuuguucucacaccgcccucucuaaccuuugucaaauguucccaugugauugauauuccucaagcaauuauauuuuuaaugaaugaaugaaugaaugaauuacagauauggucauaauaaacgcccuagggcacuaaguccggaaccccuuuaguuuauuuuauuuaaaaaacugagaccucugguaaacacuaauugucccagaccgccuaacgccagcagggugugaagggacucgaggucacucuguagaccaucagcuccugugcacagcccccaccacgaccuggggcugggggugaacggacuaguuauacuauaccaccaagaagcccagcccagugcaugacgagccugcucugcugcagaguguguuucuacgucaguuagaggagucuuguuuccccagggaauuuuuuucuaggcugugguuguccccauaguccagaacacaagacauacaguccugaggcaguaucagcuuccaggccuaagaggaagcagaaaguaggagucuggcuuuccccaagugcagagccagcccgauggaggaggagccuccugcccacccagccucugcugcucuccuuuccccuccucauggcucuucccaagcuucugcuuccuucuaaaaacaacauucuuagcaccaugucaccuaauaccggcugucaccuaacacccgccucuguucccaaauuaaaaguaacaauuccccacggaccccucaaucucacccagcaguagcaggugaaauauuccgggguaaaucuagcacacugcagcaagccaggucaccuuaaggaaagcaaacucugggcuggcgguguagcuuggcggccaagcaccgagugaaggagcacucagagccuugaaaucaacccucagcacuggccccucucccaaacagucugaauuaaaaaggaauuaucaguaauguucuggucaaaacaaaaaaaagagcuccauucuccauggaagaaaaaucacucgggggcaaaucacaaguucauggugugagcuccugagcaggccugccuuaugaagcuccuuuuagucccuuccugucuccuccccgucccuccaugauccuaaccuguuagacagguuauucacaccugaguggacaagaugacacaaacauucugcgugcagcuugaaaacugcacaggagggagggggccaugauggccacaagcacuguucauacagauaaaccauuuggggaugagacaagcugaacucuguuaccaacgacacagcuacacacgaacccacuaaucacauuuacaaaccauuuguuccuguacagccaccuacuuaucuuuuggagcugacauaauaguuagcaggcaaugggcaacaguaggucaauggccuauuucauguaacauaauaaaagcuaucagagccaaagaaauggcucugugggaaaaggcuuuugccaccaaaucuaaagaccugaguucaaucccugguaccacaggguggaaggaaagaaucaacucucaugagcugccucaaccuaucucuaucuuucucucucucucucucucucucuuccucucucucucucucccucucucucuuuuuuuuuuuuaaagauuuauuuauuuauuauauguaaguacacuguagcugucuucagacacuccagaagagggcaucagaucucauuaugggugguugugagccaccaugugguugcugggauuugaacuucggaccuucggaagagcagucgggugcucuuacccacugagccaucucaccagcccccuuccucucucuuucugucucugucucucuccacacacaaacacacagaaaacauaaccaaaaaauuuuaaguuuuaaauucauaguaauuuuuguauuuuuauuucaauagauaauacauaaacccugaauaaauuuuuaagaauaagaauuagucauguuuaucugcacaugccuauaauguaagcauguagugcugaggcaggagaaucacgaguuuggggccaguuugugcuacauagugagacacuguaccaaaaguauaaaaaaaaauaaaaauaaaaagaauuacaguacagaaagaaguuacacagcaaggacagccuggcugcauaucacucugccccugugaagggucugaguuaaucaacagucucuuucuaaauaaauaaaauuauggaaggaagggagggagggagggagggagggagggagggagggagggaggggaggggaggggaggggaggggaggggaaccuggagagauggcuuagaagaggggcacuggcugcuuuuucagaggacccagguucgauuccuggcaccaacauggcaguucacaagugucuguaacucuaagaugugacuuucacaaagacauucauucaagcaaaacuucaaugcagaggaaagauuuaacuuuuuaacacacacacacacacaccuacgaaagaguucaagcauguccuucgaguguuucgguccuugcuugguagaaacucacucuuaggguacucacacaccucccucauccuguguacucccauagcugcucccuaacuuagcuuucuuugccuccaucucacagggaccauggcugccugaauagcacgccuuagcuggaccucugaggcauacaacugucauggcuucaucuggacucugcucccuguuccaagcccucugccaaucggucagcacgggccucagagccaguauagacagcugcagagucgucagcuuuggugcucaucugaccuugacauaaaagagagugaccauugcuucuauuugaccccugaucuuuuauacuggccgugaccuucccaaucacaaggcggccuagcucccaugugaguuuguauguuuggccucgucucuggaaucuuuucuugcaauaauaaucucuucagaaauccgggcucuuuucagaauccgaucauacuuuuccuguauuuuucuuuuuacaguauugauuuugugugucugaauguacauaugugcauaugugugugcacaccacaauguucaugugaagaucagaaggcaacuuacagaacucaguucucuccuucugccauguaaauucucgggaaucuaacucagguugucagguguaguggggcaaccaguaccuuuacucgcugagcaaucucucaggugacuuuaguggugcaaaguccacucuaggcuuuuucagucuuuagagguugugcaacaucaccacugccccccuaaccccaaaacaucucccuuauccacuagcagccaguuucccucccccaacacccaccccuaaagccaccaaccuagcauugcucuugcugucucucuaggcaucuccugaacauggugucauagaauguggucugugccuggcuucuuucuuucucucuuccuuccuuccuucuuccuuccuuccuuccuuccuuccuuccuuccuuccuuccuuccuuucuccuuuguuucuuucuucuuucuuucuuuucuuucuuucuuucuuucuuucuuucuuucuuucuuucuuucuucucaaggucauucauguucacccucauuccuuguuuuaugccagugcacauauaaacacacuauauccauucacuaucuccaggaaagccaaauuugggcagauacaugaauacuaguuuuuguaguacauguguaagaaaagacacauucauguccacuuuucaaaagcauauuuuucaugacuggaucauauaguaacuuuucuauuugggucaguuuuuuuguuugaguuugacuuugggaaggguguuuuaguuugguuuguuuuuuguuuguuuuugguuugguugaaugguugauuaguugguugauugguuggcuggguuuuucaagacagggucucugugcagcuuugacuguccuggaacuuacccuguagaccaucuggccuugaauucaagagauccaccuaccucugccuccugggugcugagauuaaaggugugcaccaccacugcccagccugguuuuuguuuugagacagcuucucacuauguaacuuuggcugacauaaccauguaggccaggcuggccuuguauucagaggccagccugggaauccuggugaaugcuacuuuuaacuuucugaagaauucccagguuugugccacagcacacuccugugcgucuguaugcaucugaggcccuugugucccguggaucucacuuaugucuaaugucuuucugauuaccaccgcuaccagacacuaaaauguuaccacaccaaaguuuuggucuguauuucccuaugggauacugagugucuuuuuuguauaguuauuggucaugugugaaucuucucaguaagaauguccauucaaaucacugcccacuucuaaauggaaugagaaacuacuuuauagccagccaugauagcauauaacuuuaauccuggcacuggggaggcagaggcaggaagaucucacugaguucaaggccagcuuagucuacaaaaguguguuccagaccagacaggacaggguuacauggagagacccugucucaaaaaguuguuucuaaauuuuggaugcaaaucccuuaccaaauaacaauuggugccucuuuccccccauagccucauuguuauucaaaucuccuugccauaaaucaggaucccauuucuaaauuucagacuggggcccaaagcccugcuauccccaguaagucucugaaguccagcauacacccagacccugggcaggaacugcccacaccucacaaacaacccauggcuauucuccucccaugcacacucgcccaguccagagugaagcucccacugcugcaaucccacucuagcauccauccuccguccagccaugagcuuccucagcacgcugcacucccgugcccacaccagguucacucuuucaucagaucugagguccgucccaucaacagcaccaugucuugugucuguacgacugauguuacuaucccuauuucacagauaaaaucacuaaggcucacucaacugauuauggucagauaauccaucaaaggucacagucaguaguuucguaaaacuaggauccuaaucaggucugaccaaauagacagacagacagauaaauuugccagaccacuucugugcuguauucaucaaucugcaaugcuaauaucaaaguuuauagcuuacacuuuuuuuuucugacgcuguugccccugugacauagucagucaugaauuuaauuacagauggugcaaugguucuucacuguugcucuaacuggauuugggaucaccuaggagacaggcuaauuccagacaaguuuaguuaagaagggaagacccacccugaaagcaguggcaccaucccacaggcuaggguucugacgaaggaacaaaagagaaacugaaaaguaccagcguccgcucccucugcuacacaacuaacaaugagaugcacgucuggcugccccauguuccugcugcccugccuucccgccaugaugggcucuguguuuucucuuaaaccaugacagaaauagaucauucucuuaaguuacuaugaucacauauuuuuuuccagucauaagaaaaguaacuaaagccgggaaugguggcgcaugccuuuaaucccagcacucaggaggcagaggcaggcggauuucugaggccagccuggucuacaaagugagcuccaggacagccagggcuauauagagaaacccugucucaaaaaacuaaaauaaauaaauaaauaaaaagaaagaaaguaacuaaauaagcagcuacugaccauaaagauggcaagaguaguuucaaggucaaacugcuguuucuacauuuguaguaguaaaggcucaagugugucaaggcuuuaaaaaaccacaagggccagggguauggguaaaccguugagaacucaccaagcacacuacuuggguuccaucacuagcacaggaaaauuaauuucacacacacacacaaacacacauauacgcacacacgcacauucauacacauauauaaaaaacagauaaacuuugacccaacaaguuuacuucaagaaaucuauauuaggaaugcauguuuaucugugaaaaaccaacacauucaaggucuucauucauuauugaauuaucuuucgguucuuucaguaucaauauagcccuuacucagggcuggguagguaugugaaggguggagguuugccuagcacucagaaggcccugcauguagcauccauaucacaaagcaaaacaagucagaauaacucuguguacuaaucaucguaauccucaucauaggugcucacuuuauauauuugcucuaugugcauuaaauguuucuagaaauauauaaaguaaguaaucaacuucuacuacacaaggaaagaacugaguuucuagagauaugaguaggaggaaauacuucaaguuuuugaaauuuguuucucuuuugaaaagagaaacaaggguuuugaaagacccagauacauuaaacucaacaaaagcuagauccagucccucucuuugcuuuuagcuguaagagaagaauuuguucuuucugaucaagguuuugccuaccucuaugguacugugauguauuuagcuaauacaaugugucaaaaauaauguuagguuuuaagaaaaguuuugcuacaaguugaaucucugcuaugucuuagcuguaggguuuacagucaaccccagaucccuauagauacaccaagguuaauugcuugcaaaguuaaaaugauaauuacucgccaaaguuuguaauaaagacugaaaugcaacaugggaaaauucucuagccuugcaauaccaugcaccccucucuagguuuugcacaguaaauacuggaaggaguacagccuccacugggucaucagaccaggucaucucacucaaaagcuacauggccaggagaauguuucuuucuuuuuuuuuuuuuuccuuccauuuuuuuauuagguauuuucuucauuuacauuuccaauguuaucccaaaaauccccccuccccuccccucccccucccguccccucccucagagaauguuucuucaucuuuugaaacuuaauuuccuuaccauuaaaaugcauauagccauucauauuugaaaaguccauauuguaacauacuugcuauauuggcuuggcucaaaauauaaauucaaaacuuggcucuugucccuuccacacauagaaaggaaggaaggcugcuuuaucugcagguagauggccaacucacacagagcuguaaccuuugccaccuauccaauguccuaaaucccaauuucuuuuccuaacucuucuagaacagagaaaagucuguagauauaaaaccaggagcucauguaaacaaaaaacaaaaacaaaaacaaaacaaaaaacaaaaaaaaacucuacuguucuuccagagguccugaguucaauucccagaaaccacauagugacucacaacuaucuguaaugggaucugaugcccucuucuggugugucugaagauagcaacaguguacucacauaaaauuaauuuaaaacaaaacaaaacuuuaugugaaucugucagagucaccagcucuuaccaauaaggaagcuauaccugccaaacacacuguacuugagcugggguucaaagccuggcuucucaccccgcuuacaaguucucagaaggaccuccaucaacaaauaaacauugauaaauaaaucaauagggauguggacucugaagaaaaaaaggagacugucagugucauguggacaggagaacagaacacaaugaccaaagaagacuucacugaucaugacacagaugagagaagcggagauggcgagaaggcgagagccaugcagcuucuaaagagaagauccagggggaacuaacagugaaacccuguggggcuggaggagcaacaggaaguggccacauagaaagcaagacuagccccugaggucacuaggaggcaggcuccuccugugggccacagugaggacucuggaauguauucaaagagugaaaccacuggcauuugaagcuggcaccuaccugagaaacuuuugauaaaucaugaagagcaaugguuugcccugggaugguggcuguaccagcgacaagaaguagccagaucuguguguggagaggccaguaggugacaaaucggauguugacucagggucugucagagggacuugaugguacgaggacuucaccgcuaacuggaagaauggcacucucaucuauggagccuccccaggcagcaggagggagaagacugagaacuaagagggacccaugcucuguugucacacuuccugcaugucuguuucgcggcauaauggagggaagcauaacacuggaagcaagguccuaggaucagacgaucagacagagggaaguaggggugguguccaggacuggaggguggggaaaaugcccaugggggcggggugaugaaaauugaaaaauuguuggaaaagaacaaagaaaaugguagccaggagauggaaauggcucagcugguaaaggugccagccgccaaaccugaggagccaugauugacucucuaaacccaugugguggaaggagagacccaucagcuuagacgauagcgagcugucucuaaccgccacaaguauguuauggccuauguguguacuugcacacacagcuaaguaaucacauguaauaaaaaguuuuuaaggaaaaaagucaggcagucagaaggagaaaguaguuuacaaaguuggcaaagauaaacaggugucagugguagacauggcauugagaacagcaacaacaaagagugcuuccguguccuccagcguggaccaggcucugcucuaucuuaaacacacagacaaggcaacuggaagaaagagauuaccaaaauggcuguguaaccugcuuauauagcaggcggaaaggagagcccaaguuucucgaacucgagcuccccuuggguuaagcaccuguuuuagacaagcaaggucuuucuuuacuacuuagccugugucuaucucuucucucucccugaaugcggcuuuccuucaggccuugccaggcaaugaccagagggguucuaauacuuccuaucaaagggcaugccucaagaaccuuccagacacaaucaggacagugugcauccauacaucacgccugguacuucucucaagguucugagggaaaaaaaguuucauugguuuaaaaacauuuuuauauaggucagacauaguuaaucuuaccucucagaaggcaaaaaucaagggaccucuguugaauggaggccagaacaggcacagugagacccugucuucaaaaaaagaguauuuaggaaaauguaagucugaaagucauuuugguaacguauuuuuaaugugcuacuucacaggaacauagcaggggaugaagggaacgcacgacacauuaccaucaguacaccagcauggugugucucagcagcagcugcugggaaaaagggaaugaccugcaugccccugaaaugacuggauaacugaaccacagcauauccagcacaggacaguaagcagccacugaaaggaagaagccaagggcuggaaagauggcuccgugggucaagugguuguuagaugaguaugaguuccagaugaguggaucccagcuccucgcucgucagucaggguagccaucagggcaagcuaagggcucagugaaagguucuaugucaaaacacagcaauagaagaaaacaccugacauuggccucuggucuccacgggcacacacacauacuacuggauguguguacguguauacacacacacacacagaguauccacagcacacuaaauucauucauucagcagauacuugugggacgcuuccugccugcggcuggugguguaauuucugaacuuuacauuucagcaucgaaaacacaagcacaagaacagaugaccauuucuugaaaugcaugaaacaaaauaccacaccagacuaauguggguagaaggaugagaagggagacgggcuguuguuuuuauaaacuguaaugucaaacgguauagcugugaauucaccucaagcuuuaccauuucguucccacaguaagaacuucguucccacaguaagaacuacauucucggggggcuguccucucagaauggggaagaagaaagaauguccucggcagguucccuccaaaccacaugccuggaggccgggcccauauuucucagaaagaggcugggccagccuccacucccgaaucuuaaucucauacacccacuggcaagcugcaguuguuuuuguaaaaauucccuucucguggcacacaaauuuaacuuaggcuggaucgcuggacgaaccgugagucuuuuaaguggagacaaacaugacuuauauuaaaaggaaccacaaaaacguuuacagaaauaaccaggaauguagguuuuuaaaagucaagacaaaacggcacagucacagaauuuaagaccuugcucacaccauuuaaaggcuuaaauuauagcuugugcgugaguucugccuaauuucacagcacaagacugccacaucagccgcaagccacaugaagagaaaccacgaaaaugaauuccaaauugcauuuagagugugacguagcuaauccauaucuauuauuacauuugguaaaacguacuuucaccugcuuauuagcaaauuugcggugaggguaacucacuguagcgguggguugaaauaggguaccaagaacacauacauacccauuccuaaccccuggugccugagacugugaccuuauuuggaaauagggacuucgguagauauaauuaagaagcucaaggugagaucaugcuggaacuaaagccagugacugccauacuuaugagaaaaaggagagaguugacugaggcacacagaaaagaccacgggaaggaagccuggagugagcugcgaccgacugagaacacccaggcaggccggcaaguggccuucccuuugagaguucagaacugaccaacugaugaacaaucuggacucugagcguucagcaaugaaaauacaaacuugccuugcuucagacaccaaguuugugaucauuugucacagcagccccaggaaacuaacaggcaccuaucagauugaccagccuaaauguucugcgcauguaaaagccaagaggaauaguuaacaaaaaggauuuucuccuccucaacuacugagacagaaggcaaacuguccacaggccagcuuuauacagggagaguaaaaugagacuuguuuccuuucacuaaacuggagacucaguuuccaaaggcacaauaaacaaaagcggggggggggggggggggggaaucuuacuauuuguuucuuaauguauuacaauacaucugaaagaaagagagagagagagagagagagagagagagggagagagagggaggaagggaggaagggaggaagggagggagggagggagggggaaggaggaaggggggagaagggagggagggagggagggagggagggagggagggagggagggagggagggagggagggagggagggagggagggagggagggagggaaggcacuaggacuagcauacagaggccgugccagagcagggcccugugcaucacagacucgcacaggugcagccacuucagggugaacuggauggagugugccagcccacaccuguagucccagucacugcugcuggugugguuaaggcaagggucauaccagcugaggaauuagaacagccuaaggaacaaaucaggauuuggggggggggggggucauggcagaccacaccuuuaaucccagcacuggggagacagaucucugugaggccagccugguauacauagugacuuagaguccagccaagacuacacaguaagacccugucucaaaaaaaauuuuuuuagaaguaaauuuuacuguuuauuuugaguuugguuucugcuuuaaaauaguaaucauccaaauugaaaaacuggaaaaauauugacagacagacagacaaaacacacacacacacacaaacccuuuaggccucaucuuuaaaacacaaauccuucuuucaauuacuucuuacauucaacuuaacacgugaaauuaaauaccuauuuucuauuuugcaaguccauuaacuuucugaaacuguucaacugaaguucauccuuuaagguuuuguuuacaaucagguucacacggcaguuacagauaacuaggaagcugagaacuuaagguggaaauucugaucuaauuauaaaguaagccuuguaauugaaagagacaaaugggaacuccaaggagagguccacuguaauggggguuuccgacugggugcuuucccuugggcauuuuggguucugggcgguucuggucuauaagcauaauuuacauaucaacuaagcccucaguuuagaaguaacagugaagaagugcaggaaagcaagagagaccaaaacauuagcaggucuuaucaaagaccaaugauaguccacauuucccuuuaauuguaucuuuuaauauauuuauauaugcacaugugugcacagcacuuagauggcaucaccaguagaugcagaggggcuggagagauggcucggugguuaaggugugcucuggcagaggaccugaguuugauuccuggcacccacagggcagcucacaaccaucuguaacuacaguuccaggggguucggggaaguaagggguggggaugaaggaggugggacaugcuuuuaauaccagcaauucaggaggugaaaccgacuauggcuagacuagucuacagcgugaguuccaggaaagccagagaaacccugucuugaaaaaaagguccucuucuggccucuuuggacaccuggcucacacaugguaugacagacaaaacauucauauacauaaucuaaaaaaaaaaauugcaaggcaugguggcuuauaacuacucuagagguagaaguaggcaaauaucugaauaaggccagccugguggucuauacagaguucuagaacaguuacggcuacacaggaacacaccaucucaaaaggaaggaaggaaggaaggaaggagggagggagggagggaggggaagagaagagaagagaagagaagagaagagaagagaagagaagagaagagaagagaagagaagagaagaggagaggagaggaaagaaaagagaaaaaguaggaggaagaguaacucucuuacaguggaaaaagcuaaaacuacaauaagcaaaagcuugauuuuucugccaaauaaaaucucugaaugcauuucaacuuuuuuuuacgauaucuaguuuauuuuauuuauauaugagaguuguguucuuccuguuuguaccugcaugaggugucacaucuccuugauggauccuugucacggaggugugggaaccaagcuuggguucccuggaacccaagaccaccaaggagccucuccagcuucucugaaagcaguuuuaaauagccauguuuuugauaagaacauaaauuuuaccagccagagguuaaauguuuauacuacaguccuauguagguaugguuauucaaaacugcaaugccaagucuggugacucacaaagacugccuagguuuuauagugagacccuuucucaaaagcaaaacaacuaaaaccauaaacaucccacacauuaaacacgagcuaugcacaauggcuuccuccaaauaaauaaauaaauaaauaaauaaagcagugggcaggggggguccucaggauucacagacaaauauggccgccagucagagucaacuccagcagucaugauggccgccagucagagucaacuccagcagucaugaagcacacaccaguuugcacccuggguaugacauaaugaaaccagugcuuuagcucugcaucucucuuccaacccccauaacccuaggcuugccgugagaaaagagucagggccagccaaacaaagguaagccacccaggaggaguccaagaagacauggaugggggugcaguguguuacccuggugggacccagacagaaaaggcauuagauaaaaaccacagaaaucugaaugaagauacuuagaaauuuuauauaguauuuuuucaggcuuucuguaaaucuaaaguucuuaauaaugauaaaaauaauaacaacaauauucuccaguacugcggaggcugaggcagggugacagggaguuucaggucagccagaacuccacaacaugauccuguuucaaaacgcaaggucuagggauacggcucaauggcagagcaccugcccguggcaagcaccauuuauuuguuuuuaauugugugguagucaucucuagacaaauacuaauucagauucuagacaguacuuuucuaaucauucacauugucaaaguuaauuuaagaaaaacacacaguaguuucucucaaugcuaagauuaaaucuaagauuugggguacaugaggucaaguuaaaaagagaccaacuccaccuauucaaguaaacacuuggcucacugugauccgggugugaaaaccaaaagccucacaaucgcacagcuauuuauaauaagagguuacauuuaaauuucacaaacaacaugguucugaagacacuacuaaagcagaaggcgcauccacaacuguaucagaagcucagugaggaagucuggcccugugugcaccaucaaggacuaagucuuaugccccaaacaugguuccccuggcuuccucauuuacauacuagcuccaugcaauaagcaaaagacgauaaacauucucagcauaucaaaaagauaggagaugagacuuucagaagggggggcaggggacaacuaaccuccccuuuacugacugggacucaccaaguguucagcuccagccuggaaaauuucacacugcaguucaacgaaagcagagcucacuagagacaacaaaauaaacaaggacucccucgcucucaaggagucucccuugaggaggcaaaaaaggaagaggaaggugugucuuggaguggaggacauuugaguguuguuauaguggguucagcacaaaguccugcagaagcaucuaugagacaugggggagggaucccacagucuucaucaucucaaugaacaacaaaaacaaaagacucaaacuguaaacgccuaaagcagggugacgagcccacagcugugaucuaggugcuuggaggcgggaggagcagguggucaagggcuggagagagggcugagauuaacuaagaacucugcucugccacaggguaggggguugguucccagcacccacuuagggcagcucacggccaccugcaacuagcuccagagacucugaagcucccuuuugaccaggacagguaucccccagugcagacacgcaggcauagaaguuagggaccccauccaaagccaggaagcuaauggcuacuggaacugaauggcccccaaaccugcccccgcccccagcagccaccuucagaaauauaaugcugcaagcagggcagugcacuuguguggucccagcacucggagcagaggcaggaaaacugccccaaguucaagcccuagguuuaaccagggcucacagugagccccagccucaacagagggaggcaaagggggaagaugggagagaggggagaagggagaguggggggaagggagagaggggagagaggggaaagaggggagaaagggaagagaggagaggggggaagagagggggcagaggggagagaggaaaagagagaagacaggggagagagggaaagggggagacagggacagagggaaaaagagagaagacgggagacaggagggaaggaacgaaacacuucuacuuucuucauacguguggaguaaauguucagauuuuuucaagaguuucucccacacacucagucaacccuggcauuuggcaaugacgccaagcuggcaagcaggcagaggauguccuaggucugggggcagagccucacucucuccuacaacugcagauaacaacgguaccuuagccacgaauaaugaaggauuucuucuccuugcccaaggaggagauuuucaacacauuuaucucauuccugguauugaagugaucaaaggcugggaaccuccugaggagcuuuguaguagagggacauaaaauggguuuuauuuuucagaguuaaagaaaauagcuaugugugaucaaaacagccaaaaccuucaaaaauaaaccagcgaaaagaaucccacgugacauuaugaaaaggauuaguucccuugaccacaaugugaggaucuaaaauucagaccuucaucaacaaggagcugcccacccaaagggaaaaggagcuugcugaauaaaugaucucaaagaagacuuaaaagcuacuaaacaacacgccugcagucgcaggucuaccgugggcuaaccaucgugaaaauguuuaaacaauaaggaacgauaccagaaaaaaagucagugcgaagagugcaaagaucaaagguuuucuuccugcgugauucaauuuguuuauuuaaguuguagacugcccacccaccacaccccacaaaaaagucggguucacuugagggcuucacccuccugcuguuuccuuugcagugaggcugcaggcacaggcuguaaucuguucauugagcagaaagcaacugagugagacacaagcgccucuggcaccccgugaaaccacaagagagcagauucuaguuuucccauguucuaacacaucuuuucaaagcuguuuuucuucaagggcaauacacuugucuagagucacgcgauugguaccaaaagccaaaggccaauugacacugaaggcuauaaauuaaucaaaacaaagauuuuaaagagaccucugugugugugugccucauuuacacacacguuucuuuagugaauuucaaucuauaaacaaaauaaaagcaccagacgcacuuuccuacagaaacacgagcagucuucagcgcuaaaguagacaucaaaagauuccuucaccagcuuuuuguugcucuuaggaaaaguuaucaacuucgcuaacagugaaaugaaguaaaaagcccucuggagaaacuuuuccaaaacacuuaucaggaaaaagaaaauacaaaauaaauugauuucaaaguucuuucuucacaaccuuuacagccacagacagagucaugaaaaguagcaugcuguggacuagagagauggcugccccugggaacuccauuuccaaaggauuuggugccuucuucuggccagaggacacuuguacacauacauacaugcggacaaaacauucacacacauaaaauacaaauaaauaaaucuaaaaauaaauagauguaaagaaaaaaauaaagaugucugaucuaaaaagggaaagaacuguaagcgcaaguugaccucuguaagaauauaagcaacacaaagauaaagguagacugcaaacaaguagcuuauuguacuucuggucccuggggagugucagucacccacaugacuccugccacugacaggacccagggcaaaguuuaggauagaggugggacucuacaaggguagcacuaaggaaagcgucuuuccuuagacucacaccuuaaggagugaucaaggggcugggaacacagccagggugauacuguuugcccagugaggaucgacugcugaacugaauuggagauucacugucgaaacugaaugagacauggcgguggacaacucuucaaacugugggagccuggacgacaagacucuguccccacaaaaucuaagagucugaaggucugcagucccugcaccacauuggggugcagccuaauccaccacagguccugcuuuauguaugaaugccacccaggagcaacagccauaggggagaugaagccucugccuucaagagccacuguaaccuuuucuccucguuguaaaggauccuucuucggguugcaaggcuuuucugauuuuugucucucacuuacucucugacccuuuccucaguggcuuccccguguuuucuuacacacacacacacacacacacacacacacacacacagagagagagagacacacacagcccugccuccgaugugagcucacccuugcauagggaaaaagaguaaagaucuggaaaugucuuagggguccuccugaacccagcaaggaguaucagacugauaaaagcacacacuuagagcacuugagaggcagaggcagagauuucugaguucaaagccagccuggucuacagagugaguuccaggacagccaaggcuacacagagaaacccugucucaaaaaaacagggaaaacaaacaaaaaacaaaacaaaagcccauuagcuaaaacuggacuguacuucacucaaugcuuguauguuccuugcuguaauauggcuaucuacuauguaucuucuucucaaguggccaaaaaaggaaaaauguaauacauaaugcuauaaaaauauuuuauguucaugaauugucaaaauguuaauuuuacuuuaugaucccacauaguguuuaaaacacugauucaauaaacucuauguguguaagcucugaaacuaugucucugacuuagugcuaucuucccagcaccuaaaaugcucuggcauaccacaauugucagacaugcaugagcugaaucugaucuuuagugaagaauauagcagagacauuuauccugccguuucugacauuuagaauagaagggagacaggaaaagacaaaugaaguaaaccagaaggcugagaaacacaugcucauacaugaaauugaauauaaaaaccagcaguagaaugggucauagacagacuccucaagaaaggaugcugagccaagcauggugacucacgccuggacuccaagcacucugaaggcagaggcagguggauccugggcuugaguuugagacuaucuacaaagcaaguucuaggacagccagcgcuacacagagaaacccugccuauaaaaucugaggaggaagaggaaggaggggggaggggagagggaagaggaagaagaugaagaggagcuaugcuucuggcuguacuccaaugcagaauguugggggaugaagugauaauucaucuauaaaucuaaaaauugagccugcacacucucuggauccucccuuaaacuuuauuacacguauuuuuauauaucguaaauauauuuagaugacauuuaaaugagacuuuauauuaauuuaccuagaacacuaauguuuaauaaaguaaaauguuugcgacaugugaugaucagugcuaacuuuacuucacccugacagaaucuagaaacaccugggguaugagccucucguuauacaugggggcauucucuggacuacuuuaacugaugugagaagacuggccuuaaauguggguaggagcauugucuggguaggggagccuggacugcgcagagaacagagccgaggauugguacaaaugcaugcauacgaccagcugcuucaaguuccugcugucgcggacuuccugccuuaauggacugaaccuuagacugugagcuacaaucauccuuuucucacuuauguugcuuauaucagaguauuuuaucacaguaauagaaacaacuaagacacuaaaaacucaccacuuugugugucugugcaccauaugcuuacaagagccuucagaggucagacgagggugucugguccccuggaacuguaguuucagacaguugugagccaaacgugugggugcuggaaaucaaaauccaaguccucugggagaacaacagugcucuuaacuacugagccaucuuuccagcccaacccugcccccaccacacacacacacacacacacacacacacacagcuucuugagcuuugucgugcuugucaauuaaauaugcaugucacugagauccaaaucugguaagauuugcuacgaggugguuucauuuuguuuuguuuacauguaugaguguuuguuugcacaucugugcaccgccacaauaccuagugacagaggaagccacaaggagacauccaaguccauggaaacggcauuacagauggcugcaagccuccaugugggcgcugggagaagaacucgggaccucugcuagagccuagcauucagugagcugaaccucugagcuucucgccagcccuggggaucuuuccuugaugcuuuuaguguuagcauguucuuaugucaaguuggcgucaaguuuguugaguaacuuuuuaaaaugacauaguuuugaacuuguaccaucagauccaauauaaaauacgucuucauuuacuuaaguguugucagccuugguggaaggaacucuaucagugcaaggaauuauggcacugauauuccacaguguuugcacuucugggaaaggguguguguguguguguguguguguguguguguguguaauuugguuuggaugagaaggugucuugcucaucuuaucaaaagcuggcuucagauucccccuauaaccaaagaugaccuugaacuucugaccccucugacuguaccucccaggaauuacagaccugggccuaccgacuacauucccaggcccagggcucauauuuguuugauguuguacaaauacauccucuucauuuuaucuucuaguuuauaaaaacguauaauuuuguauaaaacauuagacuauuuccccuaccacacugcccagcucuggggacaagugaggacuugagagagggcaacaauuaguucuauuuugagcaaggcuuuucucauuaacuuccucaaauugaaaauuuuuaaauuccugaaaccacucaaauauccaaacucuuuaagugaauugggcuuucuuuucuugagcaaccucauuaucccacaguaugggaucagcagugguaggaaaggcuuccacacaauagcaacaaauccaaaaucccacaaauacaccuaaugcugaauuugcaucaaacuggaaaguggcaacuuaacacauuaaguaacuggacuauuauccagcuucuaaauugaagcuauuaaaaaaacgcaggaaaagauggcucagccuggcaaccugaagucuaucccagguucccacauggcaaaaaaauaaaaaaagggaaucaacucccagggauuguccucugagcucucugacacacguacauacacauguacauaaauaaauguaacuuuaaaauguucucagugauaucauuaugauuuuuagcccucuguauauuguaauuuuggguuggguuuggagaacgugggaguuggaggaggcugacugcuggauagggcaggguccaaggcuucccaccucagggaaagccaccuuccuuccuucccucuaagcuacaucccuguccccagcauuuuacuucaguuucucuuccaggaaguaugucacugucuccacaucuguuuaaaaagaguuacacacaagccaggugugguggcacacgccuuuaaucccagcacuugggaggcagaggugggcgaauuucugaguucgaggccagccuggucuacagagugaguuccaggacagccagggcugggggggggggggggagggggggagcaaaaacaaaccaacaaaaaaagaguuacacacgucagauuaaacucuacuacauaaauuaccacaauaaaacgucucaaggaaccuguuccuuuugggggcuaaugugugagaacagacaauacuguuuaaaaaaaaaauucaaccuucacaguucugacauuggcucaguaaacccuguguaacagucaaagaauaauuuuaagggauaaacacucuacaccuuuauuccaagcaugcaaucccacagaggacacagugccacuaagaacaaagugcacaaaagucuguaucaucaacaacuggaacucuuaugccagccuguccaccacuugcaguccuacaagcuaaacacugaaaacccauuaugaucuugcuacucaauucagguguauaaaaugcacuuauuuaaaaaaagaaaaauucacaggcuggguagugucucagauuaaagugucggaucuaggggcacagacaagaggacagaggcucacucgccguucuaaagggaagaaaaauagccaucucaaccugucacacaagcaccacagcagacgcgcaccuucacacacaagcguauaucacacacccacacaaacauacagaugacagacacagacagaaagagaugaaacagaaauugcacaaaucaaauuaggucaaaacaauagugagguuuuaagauaugcaugcacgcacgaauuucauuacagaagaaacaguuacugauguacucaaaguagcauguaaaaacaaaaauagcccagcuggugguuggaucucaaaacaagggcuguaagucccacccaaaaaugcaaaauaaaauagguauccacagagucaaaggggaaaaaacagucuugccacucacucacucacucacucacucacucacucuacugcacugggagggggaaaacaacucaugcuuccuucugagugcuuaaagcagucaauuuacuaauaaacuauguugguauauucccccuuucucuuucucugccucccuccuuuccucucuuuuccucugacugccuaaaaugaccccauaggagugaggaaaggaaagggaaaaggaaaaggaaaaggaaaagggaaaggaaaaaucucucacagacucuccccacuuccauguguucucuugaagacaagcuugcacacucaugcgcacacaaacacacacacagaaagagagagagagagagagagagagagagagagagagagagagagaggcagaggcuaaauaaacacaucuuugaaauuuuaacuaaaaaaaguuuaccaagcauaagcagcuaccauaugaacucacucgauugcacuuggaagucaagccauuuguaaaacugcuauuagaaucaugacaacaagcaucccugaaaugcaauacgacagcaagaaguuuccucuaugagccaagcucuccacaagaaaaggaaacucucgcauacagaaugcuggucaguuccaagaugucuuccaggagccaucccauugcguaccacaauuuaccagagacacgugucauggaugaaaaugauuuauuuauccuuuccuaugcucugggaacugaagacaaauaagugccucugcucagucacuggaaaaauaaggccucaaaccccagucagaccugggggugcaugaagagaaaaacagaggcugccugcacccaauggugacugagaugaagccaagcagcucccuggaaagaggcuaacaacaaaagggcguggagauguaccagaguaggaccacacuggcaacaagcagaaacgugucagcaauaagcacagcaggcacggggcaugagaaucaggagucaguuacccucagcacauaaucaggcuggaggucaagcgggaguuaccgaagacucugccucauaacugaaugaaugaaugaaugaaugaauguuaaauauuaaaugaaugagugaacauuaaauaaauaugcuccaaaagaacaucugacaaaacuauacuguuacaaacauuaaauuaaaagcauuaacaagauauucacagaacucgaccaaaaaguauuuuuugaagaauuaugucugauggcaaggaaaauaaaugguaacaaaaugagaccaucugcuguuuccauucugauuuaacuguuuuaacaucgccaggacuaguucagauuagccccagcacuugucccagguuugaucccagcaacagaaggguguggaggacuuuccagccagagcaauccaggacacaaggacaaacaggugcugugaugccagcaccugaagguagaggcacuagaggaugaagagcgccguuauccuuagcuacaaggcugcauucacagccagagacuacauaugagacccuaucuuuaaaaaagaaagaucuauagaauucauuuacauaaagaaucuaauuugcaaaccacaaaagaucugagaagauaacaaagaagcuacaauuagccacugugcaguugaaaccacuagucauuaggaagaagcaaaucaaaaccacgguaagauagguagcucuauacacucaggagaucagcuaacuagcaaguggauucagggccaccggaguccuccagacaggcuguagcuguaagugguaucagccuuaugggacacugccaagcugcuuuccaaaaugaugcacuuagucucugacccaagugugucaaccuccaaagagacuuuauucacaguuucuaaacacuagaaacaaccuaaauguuccaucgacaagcagacacgaguuacuaccaaauaaggaacaaacuaccaaaagagucaacaucauggaggaaucacaaagcaaacaugccacccacaaaagaauacacugcagucauaucaugucaagacugaaaacaagccaagggcugggagccggucgcuggguaaagugcccgcacauaguugcacaucuacaauccagguccuggggaccccuggaccuugcuggccagcuagccuagccaaauaggcgagcucccgaaucagugaaagguaucuuuccaaacuaaggccagcgagacagcucaggggguaaagauacuucgguuccugagacugauccccacugaucccagaaugcauacagaaguggauggaacgucacaaagcuguccucugaccuccaagcgcaaugcacaaugcacaccuacacauauaauaacuaauaacaaacacgguacgguguuugaagaaaauaucaaggcaaccccuggccuccacauggacauauacacaauuaauaaauuaacuaauuaaauaaaaaaaggaaaguaugucuaacuaaaggcugaucaaagucaggugguuaccuguggaggcugcugucggggcagagugaccuuggagugcuagaacauugcacucguuugucaaaacucauauaacacaucuauaaugggugugccaucgacuguccaguuacuacuacuuaucaugauaagcaugucagcagcaagaaacaaaaaacagggaaagcccuugccucccguggcagucuucugaauugcuucggcuguguuauuugguaaggugagcauuuuguauuuuuaguaauuuucaaaaguauucacucaguuuucucagucaguuaauaagucaguuacaggagcugcaaagauagauggcuuaguaguuagcauguuaacagaggaccugaguuugguucccagcaccaacauagcagcccacgaccaucuguaacuccaguccccagggacccgaugccccucuucuggccucuaagaacauaacaugaauauggugcaucgacaaacacauguagacaaaaaugcucauauacauaauaaacacauuuuuuuuaauuuuaaaaaagaaaugagaagggagguugaugaaauaggaacacuagcagacugcaguacuguguauauaaaaauguagaaaagaagaagcuaaguggguguccaccacaagcccacacccucaagcaccaugaccacauauuauagcucuggaaacuaagacugggagugggaaugauauacaugccaauaaacccugaaagaagacucaacgcuauccagcucauuaaaaccaggauuuuugaguucuugggauuagaaaauggggagaauuuucaacaaugucucaguuuacuggaacucacaggcagccacugguuuagaccaaguuucuacacuaagccuuacaacaaaaccaaaaugcugcuacucagccugaaaaauuacacucccaagcugcaauugauugucugaccucccaagaagucaagaggaagagaaaaauaacaccauagcuggacaggcaagcugaaugaagaagauggucccuccagcuuaacccucacaagcaaaguuaacugaacagccaaccaaucagcauuagccguuucugcuuccgagucucugcaggaaccuguaguagacuucaaagucagcccucucugcaaaagugcugccagcauauacaacaacgauuauuaaaauaauaauaauaaucaaagccaacucacccuuuaaaucugcucagcucuggaaacuaaggcucggagccguaaugauacagauuccaaucaacagugaauaagauucacaaaucacgugacgaucaaucuuacuaucaaaaaacaggguuuuaaaucugugauuguguucagaauuucucucaacaacuaugacggaaacaccuuugaccaccaccaacagaaaucagaucuggggugaauaggagacacuuguaaucccagcucucugaggcaagggaauuccacguuugcaaccacccuggucuacacaacaagacuuuguuucaaaaagaaaagauguuuuuaguugaaaucuguauuuagauguauuugcugcccuuuauaauuagguacauauaauauagaauuaaaagaguauucuguggcgagagcauaguagcauaguucagugguagaaugucuguugagcaugacaaagauccuaaaucuaucuaucuucagcaucuccuguugaggaguuaucaccuaggcuuuauuuaacagauugacaaaagauuccuucacacacacacacacacacacacacggaggggugagucugccagccacuuucaacagcccauuuuccaaacguguuccauuucaagauuuuuaaaugucuauauucuucagcagcaccaccaccaccacugugugugugugugugcguguguguguguguguguguguguguaaaacaugcaucaucaucaucacugucauugugugugugcauguguauauacacauccucaaacauguggcugucagaagacaauuuuguggaguucacucugucuccuuuaugugagauccaaugcucaaacuccggucuucaacaaacaagcacuuuaccacuaagcaaugucaccaacuccaucacaacaguuuaguggcucuauuuacaacaggacaaaaugaauggcucugcuuuggggaucacaccagugaaagaauaaguaucuuaggaaacccaaccacgccagaagugaaacacuguuuccagaucucaaaaauuuacagagagcaggcaccguagcuaaugccugggaucccugaguuugggaggaggaggcaagaggagccugaguucaaccuagacuacauuguaacacccuucuucaaagacaccaaagcaucaaaugggaccccagaccaaagaccacacugauuuucagagauuuaacugcuuagucaucauaucccaaaacagcggacaauuacaauguaaaccuucaacucagaagagcauuuagcccucuuuccccugccuuuacccucccucacucccugugccccucaccaggucccagccacucccuguuaaaugcaugcugcuguaguguuugguuuauuuaggugcugaggacuaagcacacacucugccacccaguacuacauauaccccgagcacugauuaguuucuuucuguuugguguggugggggagggaguuguaugcauguucaaguacuaagaugcagcaguaaacuauugaacccagcucuuaccaguauuuuucuuaugaaauuuuuuugccuacugucaaucaaacaucccaggguuuucauacaugccaagcaaacacuuguaguacagccuacaaccccagccucuuuaauauggaaaucaguaauggucaccuaucuaggacccagcaaguguggugaccucaaauucaguccccaacaauacauauaagaacuagaauauucuuaaugucuagaaaccuaaaguccaaaauucgcugagauccaaaacuuucgucauggaauauuugcaaaggccuggauuuauaugcauucuguuuuguuugguuuggugacaggguuucucuguauagcucuggcuguccuggaacucacucuguaaaccaggcugggcucaaacucagaaauccgccugccucugccucccgagugcugggauuaaaggcgugugccaccacugcccggcuuauaugcauucugaauuuuugaauugggaaugcucaccuauaccugagggaaguggugacacccaaacacuucugcuccaggcauucuggguaagugacaaacauagaucuuaauauuccuccuaccccaucucuccaaaaagcagacuuuuccaaauaagagcaaguucuguagaacaagugccaaguauuuuguuuguuuguuuguuuguuuguuuguuuuauccuaaccuuauaaucaccuagccuguagcaucggcacacaccuuuauccuagcgcucaggaggcagacgcagggcgaucucuguguguucauacaauuggaauuuuuuuuuuuucagcaauucacaaggggaagcagcacauuugcuaaauaaauaauccuauacugccagggaauuuuuaaacuccugaugaaaauguucuccauucaaguuauccuccccucugcuucccauucucuacuccaaccaccaccgcccucuucuuugagacaggaucuuguauuccacgcuaccugccaauuuguuacaugguggaggucagagagcacggugccaguuuauggugcuagccaucaacccaggaacuagugugcuaggucagaacucuaccaacugagcuacacccccagguccccacaccaccaccaccaccacaccaccaccaccaccucagccuuucugagacauggucucacuguucagccacggcuggccucuagcuugcaugccaccacaccuagcccaguuacccauuucauaaaugagcgaacugcauggccaagguaguaaaaggcauagcucagaacccaggcuuaguauuuggauagucccuacuuucuuuucaucuugauccacaccugcauaaagccguauucugugaacacgcauucuguauacauagucgugcuaugagaagcuaaaagcaucauuccucaaacagaaaacuuggggcaaauuaaucaucaguuccaguaacuacccagauuaaaucagacacagagauucagaguaauuuguagaaaccauauaaagccauuuuaaaagcaaaucacaacacacaucuuucuguacaagugugugcacacacgcuugcagacacacauuuuacccacaaauagaaacuucugacugcaaaaagaaucauaaccaaguuguauuuauuguuugaguaaacauggagggucaauuauuucccacccuuaaggaaacccccaaaagaacacauuucuaccuugucaacaaaccaugauaccguuaacaucaaaucaagagcuagguuuccaucugacugcauaguuaagccugagcacacacauucccuggucugucuuagcuauaacuaacuacaguauaacaauaacucagagacugcuguaaacaagaagcaagaugaucagcacacuugugcauaaacacuagcaacugaagacucuggugucaccucuguaaccaucuccccgcccaggcaggaggugacaauagccugaagcuggugugugguacuugugcauguacacagcacuggcauucccaggacagagggcucagucuuaagcuacauuucagagcagagcuggcccuaagcuagcuuuaucaguaacugucauuaccagagcugguagaacacggaugugcuuccagagagaccucagcuacgcuuuccucucccagagcacccaucugugcuccucucagguccucagaggacagagaggguucggguugaagaagacacauuguucuugcagaggaccuggguuagguucccaugaagcagcuccagcuccgggggaucugacaccucugaccuccacagacaacauauuuaaaaacaaaagaaauacuuuuuaaauauaauuacuuugggccuaaaauuuuugaagacaugagaaauaucaugacauaaaauguaaaguagaggcaguaguccuaucagggagggacgugagggcagaaaggaaagacacaacccaacagcuaaaauaacauuagucauugaauuggucucccguacuccuagccacacaguuguuuacuuauuacaaaggcaacaacaguacuuucucagugcuuaauaagcacugaggucuccugccaucaauaaugggacaggcagacaacacgagccucuucacaaugaugugcuagauaaagacagaacagcacugugugacauagcugccccaaacacaccauuuaauucugguaacugcauaucacacaaacccaaaugugggaucucuugcaaacaaauggaagacuaaaaauacaugacaagguaaaagcaacagcaguccuggcuaaauccuggucggaaaggacgucagaacaagguaaauuaaauuaaguaugacuaugauuuccugguucuuauaacaacagugugguaugugagcaacucaucagaugacacacacuggguuucagcaauugaacucccauacaugcagaaagguuggagcacagcaacuggggcggggggggggggggucaaaaaaaaaagucuccaagauacuacagaagcagcuggaggagaccagggccugaucugaauacucccucaaaaaaguccuacuaagaagaaaaucugagccaaaaagaugacuaagaaauaacucagaaauaacagaaaauuugguaaagaauccagcuuugaaccaggugacaguggcacaaagcucuaaucccagcacuuaggaggcaaaggcagguggaucucugaguuugaagcuagccuggucuacagaguuccaggacagccaaggcuacacaaagaaauccugucucagaaaaaaaagcaaaacaaaacaaaacaacaacaacuccagcuucacaagugucuuguauaugacugugcugcgugagaccuuuucucaaagugagaguuuuaaggccagacaugaugauagcucauaccuuuaaucccagcacuugggaagcagaaacagguggaucugggugaguucaaggccagccugcucuacaaagugauuuccagaucucauaacagagauccugucucaaaaaauaaaaauaaaaaacaaacuaagaguguaaacagaguagaagggcugggggaaggaagagggucacacaggcaaguaauuaauaccccaggagagcaguccuucucuuaggugugagccaggggcgaguuuugaugacuacacuguggcugcccagcugagagcaggcaguagccugagaaccauguguagauccagcaacacggaucacagaucaaaggacuggaggagggaugccggaaaaagcacugugcuucccauucaagccccgcucugcaguuauuaaauaaguggccccuuuuguuuugguuuguuuuuuuuuuuuucuuccuuugguuuuucaagucaggguuccucuguguagcccuggcuguccuggaacucacucuguagaccagccuggccucgaacucagaaauccaccugccucugccucccaagugcugggaccaaaggcgugugccaccacugcccggcagcggccccuuuuguaaaaagacagaaauacaugcacagugacacugaaaugucaggauuagccaacucuacacuggcuucaacaucagaaaaugugaauucaaaucaaaucuguugccacugcaggauuuugagcaaguacuaaacaacugaguguggguuucccccgauaugaaacggaaaugauaaaguaauuacagaucaaguaaggcaacuccuguaacauacaugcagccaggcuuggugacacacaucuucuaccccagcacucaagaggcagaggcaggcagacguuaucuacaaggguuccacacagccuagucuacauagcaagcugcaggccaaccagggcuacauaguaaaaaaacguaucacaacauauaacaauggaguauuauauggcuuuuccuuuuacacuuuuauugaaaccuacuaacacagguaaguuaauaaaugagaggaugcagggccacuacccagauaccagcuacuugcuugggauaucaucaaguuuguuacccucuucaauggcaaucacuuaaugguuguauaucaauauuucacaaccguaacauuaacucauaacccaaaauuacaaagaccgcagggcuugaaucuguuacacaacacauaccgggaccggucuaagcaaacagugauuagugguggagaagucauccaauguaacgaucgcggggauccgcuuaaguaauagucuagaguaugacaggaggguagggaaaggaauguggaguauucugcgacaggcagagaggacagcugggacaaagccgcuggagcagcagcugugcaccacgcacuguccauccaaaaccagagacucaaguaacccgcgucagacagcuucaucugccuaacgcugcuuccugaaacccugcgccacagagaagccugaagcaggcacaucacagacugcaagaagaccacgggagccuccacgguuaaaacugaaaacggagaugugcagcccaaucacagucggcagaggugccugcccuauuuucauaccuacucaagcagugugugcugucaucggccacaggcccaggugcucggcaggcggaggcaggacagcuggggucugugcuccaaaagcagucaaggcaacaagcacugggagagccaaucucacacauaaauaaaaggguuugauuaaugagcggaugaccacagaaccuccccgacuucacaaugguaaggaacuccaagacucaagauguggugaacucugaacuacucaaacacagcccucaccauucccacccuguucuuaacgucuuuaagcaaagcacuugggaggcagagacaguccagucugaguucgaggccagccuuauauacagagcagguuccaggacagcgaaggcuagacagagacacccuaucucaaaacaaauaaacaaaaacaaaacaaacaaacaaaaccaaccuccgcuuuaaauucuguuucuauguucuuuauuucaaaaccccacaaacuucucccucaguuaagagucucaucuguagcccaggccagccuaaacuccuggugauccuucugccucagcuaggaucacacaggcaagugccaugaugacaggcacccucuaaggauaaacccacucgaguugaagacaagccuguguguacauguacaaaaaugcucacagaaaguuuaacgcaaacuccuaccucagcuagcugccacuucuucauuucagaagcaaaagaccugaaaucacaaacugcacagucacgucugucuccgucauuucugagccaucaacauucugcccugucacaaaccuuccuugaaguuggacgugacuacccacucaaagauccucuccuuccagccacggcugacuguucuagucucagccacacgccaugauggaacccaaaauaaggcauuaggagaaaaacccaccaagaaauaaggcaaaaguagcaacuuuccaacuccuuucucucaaggcucucucgcaucgcucaaaucagaauuuccagagaaauuaagauauauaagacuaucuuguccaaagaccauuugggcuaaagaagacuauguguggauccacuaccauaacguacuuauguguguauguacgugugcacgugcauguacacauacagaguuucgcuggaggucagaggacaugucgucuaccauaugggucucugauugaacucaagucucaucaggcugggcagcaggcacaguuaccccagagccauauugucgacacauuuuuuuuaucucucugaaccugaagcaugcccuuuugucuacacagcuagccaacaagccccugggaucuaucugucucuguccaccagcuaguuuaaaaguguacacuauugugucuggcuuuuauaugcauucuggagagccaaaccucaggcauauauagcaaacacuuuacccacuauaccgccuccuccagcccugcugaaacaaaaccucaagauucaaauccgcacguaucauauaugaucuucucacuacagagaaacucugaaauccgaaaggaaagcuggcucuuugcccucuucaguaucagcugcuagggggacauaaauagacacaacucauuucuuccuaagaccuuguuuugaaacagaguuucauacagugcaagcuggacucaaacuccccauacagccaagagcgaccuugaacuuugauccuccagccuccaucuccccaguagaguacaagugggggccgucaugccugcuccuaagagcucuuugauuuccgauuaaguuuuauucaagacccaaugcuaacaguuaagaaacauuaacggauauuuggcuccucuuagcuacguacagcaaagguguuccuggccugugagucucugaauccaguuagcccaauaugaggcacaagcaaauacaagucugaugucaagauaaagacacaaaguauucauugacacacuugcuucugugccagcaaacagggucaaaaauagugucaaggugaauggagcugaaagcaaugucuagucugaaguacucguggggaugcggacgcagcaucuaaacaugauucacaagcagcucgguccagaugaaaacaacuuucuaccuaggacaacagcaaaggcugaggggagucagccucuacuucugaaaccgucucuacaccgauauccucagugccagagaaauaaaaucaggguuucaggcuaggcuacagaguacaacuccaucucaaaacacagaagaaaauaaugaaauucuuaaucuugccagaacagcagcacaugccugcacucuuggcuauuggagacuuaaguuaucucaauguagaggucagacugggugacaacuggaagaccugggcucacauaacaauaauccaucauuagugcugccucggaggauguagcuuagucauaacagggacaaagcucuuaguuuaauccccaaaaccaccaaaauguaaaaguccuuacuguucuaagacacagaaaaucuacagguccuuuccuuugaccuuugacccacaaucaaaaggacccacucaaccuuucuccaaacauaaguuacauaaaacuuaagaugacggggauuagagagacagcucagcaauuaagagcacauguuguuccuauggaggacccaaguuccguucccaguacccacccaccucuggcagcacauaaccaucuauaacuccagcucuagaggauccaacgcccucagucagccuccaugggugccugugcacgcgcgcacgcacacacacaauauaaaaaauaggcaauaaaaagaaauccaaaagaauaaagaggauacccaaaauaaaauuacaaauguccuaacaguaaguacuaaacacuaucuaaaaaaaauauauaguucauggaaaaaacaccauagugagaaacaaguauucauuuaccugauuuuggaauaaugaaaaccagcaagagucuauagaugaaaucauaaacaagauaacaauguucaauauuguggcacacaggcacacacacacacacacacacacacacacacaccuccccaaccucuuucuacaugcuccagugcugaaagaugaacagugaaggaucuaaaacuugaaagcugggcuggcauuguagcucaguaguagagcauuugcauagcaugggcaagucccuggguucaauuccagcaauuaaaaaaaaaaaaucucaacugaaaacccuauacccucucucuaaaaaucauaacgcucugccaaaaguucaggcauaguaacuacacugaauuucucauguugaaaucaucuugauauucuaaaaaugcaaaaaaaaaaauaaaaauauugcugggcggugguggugcacgccuuuagucucaacacuugggaggcagaggcaggcggauuucugaguucgaggccagccuggucuacagagugaguuccaggacagccagggcuacacagagaaacccugccuugaaaaacccugaaggucaacuagcccuuuuguaucaaauuuaugaaagguucagaauccuacagcagugucucucggcacaaaucaguucuugacuuccaacaucaugaaugcuucuacauaaauaaagaagaauacauucuucuccacaaaggcaaaaauaauaaccacccuagaagaaaugguuucauuaaauaguaucaagauuuggaaaaaaaaauaccaauuuuguggucuuaagaaaauacugccaccauuuaaaucagucugagcuaucaaaagacauuaacccugcuucagauaauaacgcuagacauccagaaaaugccagccacaaaggcaaaucuaacagaacuuccuagaauggaguuacuuagaacaguauggaaggaacauuacacagccaaugaaugcaggaaucgccuggcacuucagaagauaacagaaaaagauaaacacaaaacuggagaugaaaaccuucccagcccuaagaguaucucgucgccacuuucccaggcaagcuaggaacaaagaaaaacuuguaguggcauccugagaaauguuuccacugcaaugauaagugggccaggcacacuggggaaaaguuacuucugcaggagagaaaugagagggagccagauaaaagcaaagaaaacaagauuuccaccauuucuauacaucugcgcucaccaucgacaugcaaaaguaaauacaagccuauauaugcucuuuuaaaaagugcccaaaagggcuggagagauggcucagcggauaaaagcacagacugcucuuccagaggccaugaguucaaaucccagcaaccacaugauggcucacaaccaccuguaauaagaauuuaaaaacaaaacaaaacaaaacaaaaaaccuuugcgucugagcaaguggagcccgaagcgaguaagagggagaagggaagggaacaaaaauugccugaaaguaauucagugcacgauuccccccccaaaaaagaguggcugagugggcaagggaaaggacaccaaugcagcucacuguuucucacaccugagguccugauuuucuagccucagcagugagaguaggaggaaaacaucaaacaaguaaaacaaaaaaaucacaaacuaacaaaaaagauaagcauaauuaauaacauauacuauauauucuuugcuuuuauugacgcuuauagaguguauguaccacaacauaugugcaauacccacagaggccaaaagaggcaugggauacacacagacagacagacagacagacagacacacacacacacacacaccccaccaccccugaauuggaguuacaggugguugugagccuccuagugugaauucugggacuagaaccaggguccucugcaagaguggcaagugcucaugaccacugagucaucucucucuccaucccucaacauacuguauucuugaaagccugcugaguggaugugugguggcuugaauaagaguggcccacacaggcucacgcugcguuugaaugucuagucucuagcugguggaauguuugauuagcuuuagcucuggccuuguugaaggaaguauuaucacuaagggugggcucagucucucccucugucuccaucucccucacccucuccugcuuucggaucaauaugucgcucucagcuacuucuccaguaugucugccaucuaugugccaucaugccaagacaccaacuacaaacuuaggaaaggugucuuuaaacagagaaaagguugguuuccuuuaugccucagucugguuauguucaaugcccagcuauucuuuaacuagacuucacugcuauaaccaaaugguaucagucccagggagguggcagagccagugauauguuagccaucuuggugccagcuuacucccuggcguucacaagacaaaacuacccagcgacacgcuucucgggauaagcaauccaugguuaagcuaugagccucuaaaacaaacuguuguuaaccucaagcaacauugaagaagcuggcuggggggggggggugacucugaggcagggcaccucccucggacgcccuagggcugacugacuguaggagugucaucugcggggcaggaaaccucccugagauucaccgauuccaguaaacuuggguaucaaagugagaucagccaaguaccuccucuguuugagaaauacacacuggcaggagaagaaaagccagcuacuuccgcuacagagcccaugcuagccgggaacucaggacccuccaguugcagccucccgagagcuuggaucaauagcaugccccaccacacccaucaccucgcuuacuaguuuuaauacucauuuaugauucuugcuuaaucauuaugguugccaaaugguuauuuucucucugauucugcuauuuccuguguguucauucauuagucaaaauucugcucauuuauuuaucaugaucaaguuuacccacagaucgaguucgugcuuuguugagacaagaucuugcuauauaguucaaucuggccucaaacucacaauccuccugcagccucccaaucuccagggcugggauuaaccgcauagauucuuuauagacaauaagcacuugucuauuuuaaugauaaacugugcccaacucagcacagaggaauucuuccaggcuugcuugucuuucucagagaaguucucaucauuuugggguuuuuuuuagaauaauuccuuauacugcaggacauuccaagcucuccuugcauuuucugaccccagcccuggaaucagaugucucucugaaguuccaucuggcacucuggauguuagugguccaccauuucuacagcccucaauggagcuggaaaggugcucagcaagggacucagaugcauacacauuucugugucaacuuuuuaccuugugaguucaggcuaaccuuugcccuugccgauucuacagccuccucuccagcagugagacaauggccccuaguuuccaaauuacauuuucuuauuugcuaauauuaguauucaaaagugccacaaacuguagaccaaugccuaugagagaaagaaaaggagggagggaggaaagggaggggggcagaagcugaaggagacagggagggguagggaggggcagagccuagcaaccagaguucaauguuugcuucaagucccucucuaaccugaggauacaguccaaacacuggguucaaaaguuaccugaagcauuuccccuggucuuuucaauguuuguugcuaugcugaccaauuaguucauuuguuuaucuguagcccaucgucuuuguuucuugggacaagaucucacauagcccacacuggccguagacagcagaccguccuagcucuacuucccaagugcugggaucacagguguacacugcccacgccuggcuguaccccucaagaugccccuuuuccuucauugcuugacugccuuacuuacucuuugcuacuuacauaccgaguggauaaaacauuaacaugauuccaaaaagggucccugucccuguucccaccaccacuuccaguucaucccuccucccucaucagucucucaagcaucccuguguuguuuugguuuuguccccacgagcaaauacaaauuuauuuucugcguuuuuccuucauuuauauaacaggaggguuuuuucuuaauguguauguaauguacauauaugcauggaggugcacaagaguguggaagugugcauaacccacguguggaggccagaggcugaaggugaguaaucgcuuaauccuuaaucgcucuccuccuuauacuuuggggcagggucuuuuccuucgacccagagcucagggauucaucuacucuagccaggcagcuugcuccugagggcucagaugcccagaauccaccaacauguuuguccacacacgugcaugacaaacgcuuuaccuaccgagcuguugucccgucagcccgcaggaguuacuucugaacuuuuuuugaauuuuuuauguguaucaguaucuuccuguauauacaucugugcaccauuacauacacggugcuuggaaaggccaggaaggcagucagacuuccuggaacuggaguuacagacaguuaugagccaccacaugggucccaggacuuaaaucuaggucuaugaaagagcagccaaugcucuuaaccacugagugaucccagccccaugucauaaggggaagguugggggggggggcucacagggaaucaugaucuccuuauguaguagcccuagcugaccuagaacucacuauacagaccagacuaaccucaaacucacagagaucuaacugccuaugccucugccucucaagugcuaggauuaacaguguguucuaccacgcugccucuuaaucuauguugaggaaacaccccacaguucacugggaccgcucucaaucauucuuguagcuguguuucccuggggaacacaucacuguuuaguccauuguuccucuguguaggugguuuccaauucgugcaauugacugcaccuaucauagccuuguacaugugccauucccaugaugcucaaaauguaccuucaaauuucuacaggauuguugagccuauagguaaacauauagguaaucaaguaaguagguaucaauuguccucuaaccaccaaauacagugcacucacuaagaagacacugccaugcuggugcacacuggaggggaaugcagcacaaguucaaaguccuccucagacagacagcaagucugagaccagcccaggcuguaagagccuaucucaaaauaguuaauuacauaaaguuuaaaaucuuaaaaguuggcuggguguaaugguacacaucuuuaaucccagcacuugggaggcaggcugaucucugagaguucaaagccagccuggucuagauagugaguuccaggauagccagggcuacacagagaccuuaucuuuaaaggaaaaaaaaaaucaaauuagcacacacagguuaagaggacaaugaucaaggguugguucucuccuuccauuauguggguuccagagauaggcaggccuuuccucacugagccaucucaccugcucuucggugucuaacuucuaacuacagugucuccaagaugcagcaagagaacagcauugauguuaaaggcccagccuuggaacguggaucaaguaauuacugacacaaaaacaggacuccaaaucuaucuaggauaggacauggaaaaugccuuccucaaaaggcaacaucuaggaagaaacaauuuuugaggcagcuguccuagcuaacaagaucuuaagaugaauguucaagaauaagaaacaagcugggcaguggugauguacgccuuuaaucccagcauuugggaggcagagacaggcggaucucugaguuugaggccagccuggucuacagaguaagugccaggauagccagggcuucacagagaaacccugucucaaaggaaaacaaacaaacaaacaagaaaaacaagacuaagaaacacaagcugagcacaagccuguaaucaaaacacucauggggcugaggcaagacaaccucaaguuccauccaagcuagccugggcuacaaccugagaccaccaaaccccuaaacagcucaaaaaucugaccaacagauuaaguaaaaaguuaggauucuaaaagaacagcaacgggguaacauaugucuuuaaauccaugggaacacagacagccucuucucagagcugccaaagaaccauuaacccccaaaacuuaaugauuacaauuuuuguguuguuguccaugucuugguuuucuguaacugagaacugaacccagggccuggaaaaugcuagacacauauugcuaaaacuauguggacaggagagcagagagaguaacuuuugugccauccaacuauuggaacaacggaccucaaagaauuaaagcuuccuccaaaaaucucacgcuggaggaagagaaaggcugaagccuggugucagccagaagagcggcaugaauccaagaugagacuucacacaauucugacaacugaccagaucaccuuaaaggacagauuagaacugaaguuaggaugggcaggaccacaucuugacccagucuguuuaguuaugcaugccucuuuccuuccauuuaaacccaaacgucauggcaguaccccaaagaugacacagggaucaccaguccccuugauuuguuccucuucccacugccaucuucaauaaauguacuuucucugcuuuucaccauuacaugucucuuuaauuggugugucagggacaacuggcagagccuggcuugucuggggugacagaggccaggcuuugacccuaaaugcaccgguaacagaacuaccacuaagcuaugccaucauuucuuaaaaaucaaucccaaauuaauaacguuuucccaacucuaaugaaaucaauacucaccgucuaaguaccuccugguguagguggaaagggcgaagccugaaaauaauggacuacauuauggauugaggaaaaacuacaaauuuuguuuuggaagaacaucaagauaccaaaucgccacaaauaagguggucacugacuuacccagccuuggcugugcugccugguuugauuugccggcauuuuauuuacuccaaaaacccuaagcccucuguuacucucccuuuacagaugggaaauugagaccuagaaaaccuaagaaacuagaccaaagauaccagcgagucagaacacagaagaacuguagaauuacaaagagccagagaucuguucaaugaaacucaguguuucacaggaaacaacucaaagcccuaaaggaaaaaaugggagaggcagaaaccuccaguuaucuagucuggaagaagcugagacucccaacucucugccucccacucuaugucaaaaucauguccuaaccagaggcuacucaccacuuagguauucuauucacaaauagaauguacaaugguuuuuuaaaaauaaaaaaaguaugagcagccaagcuagauacauaccgguaauccuagcuaacugagaugcugaaggcuagccugggcuacagaacuuaagacuauucuuagaaccuuagcaagauucaaucuaaaaaaacaaauaaaauuaaguguuaaaaggauaugccgagguuaaaccacugccaaaguccuggguuugaccccuaacaccgggugaggugguggagaacggucaggguugggagggggaacaaaaacugaaaugccaucuaaauacacaccccccuuuuauggggagggggcacugugagugugguauguauguuuccgagucggugcggguguguuuauaagugugugcugauguagaugauagacugcagcuuuaguuacuuaaucuaagaguggcagaguaauggagguagccuuuguagaccuacaccuugucccaagcccuugaugugaauccauuugauuucuacagcuguauaauuuuauuaccccagcuuacagaugacugaaagccggagcacaggcagguucaguaacuuacccaacaucaaacucaggggaauggcugggucuccacacaggugcuguguugugccuccuuccuccucaccaagucaaccucagagccuauguuccuguuucaccagccccaaaagccccaagucacauaugccucucccacucccagcuccccacacaucggccuccucuuucuaaucuggccuguggcuccccagauccaucacauuuccacucacacaaccccugauaagacacagugcucuuuuucuggcacuagggcucgaaggcagagcuuuccacacacuggacaaaccacucuacgcugagcuacauccccagccccacagugcaucuuugaagccuuccaacacugacuucuucaaauccccuugcaucuaaaggucucaucucucacacuuacuaaagugacuauuaucaacacaguacacauugcauguucaacacaacucgaagaucuuucucauaaugcaaaaguuauaaaggacauguacugagagcuauuuaacuaguaagaaaguugaggcacagaaaagcuacuuggguguuuucauagccaauaaaccaaaggcacauauucaagucuguagaauucaaagguccuuaucugcauacaucauggccaugcaugucuuuacuugaccucauuuuugagccucuagauaccagacuacucacaaagucgucaacaaaugaauucgagaagguccugaggaagacaguaaucaccuggaguguaaggguuuuuuaaacuauuucgcaaauacccuaacuuguggaaacaaucauauucagauaguccuucccucaaaaacuuaaaugcuucugacuuaaaucuaaguaauguuauccaccgguucugggacccaggaccauccucugccuucuugguucccuccaaaaccagccaccagggagacuuagcugugacuuguuuugcugucagccacuuaagucucuuuuggucccaggcaaauaacaacugccaaaaagccagacugaagacugguaaacauaaaccaacgccccccaccauugcagccgcugccgcugccaccgccacugagcauacugucaacgcucaugacauaagcauccucucugaauacaaaaguugagcagcacuuuuuuaauuccaugaauuacuacaggagcagcuacuguucauucacgcgaugugaaaauuaucauuuagguuauggaacugugcgucuuaauaacacuauaaacaccacaguuacaucgaaauaaaauaagcuauuuaacucuaucaauucaacaaaugggugaaacaaaacaaacacacacacacacaaaaacauuuugcuacccguccucuuuaauacaguaaaaauaccuuuguuacuuagcaggguaccugcgcucucuucccaacauaugccacgccuuucagggugacaaaagcaaggagaucugcauuugcuuuuaaaaaucaaaaagaagagaaaggaaaaucacucgggcgucuuaaccuagaauaaaaucuaaagacaaauuucaccuuccuuuucuuugccacaacccgacuuuccuccuccagcaaacagaaaauagggggggggggggagaagggugcaacacacaacucauacucguccccuccuagcggggcucaccccaaacuucaccuaagcgcgaagcaggcaggcaccgggaauuccaaggaaauggucucgccccuaucaaagcacauuuuuaacuuccucgaagccauuauuucccuagggcacgaucaaacacucccacccggacguaccaccaaacagacuacuuguaagagaagcucaaacacacacaaagagaaaacacuauugggagccggcggcgcgaagccgccgccaaguagcccgggccagcgcugccaccgaggcaggcgcgggguccccacuccggcccucagggcaggaagcccggcaccgcggcgcggcugcaacccgcgggcucccgcccugaccgcagugauaagguggaacugcgcuucccacccggccagcuccgcccuccgggccacauuccugagaagcccgacuccccggacgccgcgccgggcgccuggcgggcaguagcgcggcgccguggccgcagggcaggagcgcagcgccgacuccucacuguuccugcccucgcagccgcgcgcccuggccccgcgcaaaccgcacccgcgcgcaccgcacgcgccggagccccgcacccgcgcgccccgggcggggucgccgcggccacagguagcgccaccccgccgccgccgccaccccgcaggccgucuccaggcaccuggaugaacuggauggugagcgccgacuugcccacgccgccaccgccgaccaccacgagccgguacuucuccuggccggagccgucgcgccagccggccgcggccaucgggacgccccgagcccagcccggccgccgcgcgcccuaggcccggcuccggggacgagugcggccggcuggguuacaggcgguagagcgcgcgggguccgugaguggccuggagggccgcggagcgcuaucccucggaccggcugggaguugcccgagacgcuggagagccgggaaggcuccagggcagaggacgcagcggccagggagcgcgcucuucuucgcggaucugcagcgcagccgaacgcagccuucggcaccgcuacaaauggccgucu

SEQ ID NO: 12134 - RNA, 14554 nt, Mus musculus
ggcggggccgcucaguccucgcggcaucgcuucgcggucgucuggaacuuuguugcuuggcggccugcgcugcgcgcgugcgcggacauggcuucaaacgguaugugggagcgcgaggcggcgacggcgcgucccugcgaggccucguucccucgcagcaaggcuuuuggcuuucggcugggccugcgguggcgggcgagugggcucccccaccucuggcgggaagcagcggguggagggaaggggagggcggugucgccauuuuguuuggcuccccuggcgccuuuggcgcggagaccguggguuuucucuccuggcccggucacuugagucgaguguugagagagacgcugccuggcgacguggggugaccggggugagggagcucugggucuccgcagcuucgccccacccccuccccucccuccguucccggccucgcuuugucgcagugcugcauccgggcacuuggugcgcgcacgcgcuccucuggccccucccccuucucgccgcggccccccucccccccgccaggaguugguccguuuuuuuuacuuuuuucuuuuuuucuuucuucuucuuucuuucuuucuuucuucuucuuuuuuuuuuuuuuuuuuuuuuuuuugucgcgagacccucggcggaagacuugugguccggugcuggccucgcccugcucgcugggucccuugggaaggggcggggccaccucuucccgccuccguggccgcgcagcgggagcggaagcuccuggcuggccugcguguccgugggauugggaggaccgccaggggaugaccaacggagucagggaccccggccugaguuucccacuucagaguugaguuuuccuaaggccggaaggaaaucagaggagucgcucuccgaggccacacccucucgcugucaguuuugucccagugcggggguagagcuuggguuuccugcagggagcugcugagcuacagcuucccagauuguugaaagugcugucugcuuugggugcgcaugguaggcgggagcucaguuauuuggagccacacgucgggaaccuugggagcaccaugccauuuggggguuggagagucccauucuucuagcugcuuccuugggcuugaacucaacuguguaauagcgcugacugucaaaguuaaucuugacauccggugauaccaccuuuccuguauacagagcugcugugaagauauaaaauguggugacguguguugcaggccuuggaaagaccugcaacaagucaaaaggauuuuuaaacuuaagggaugaucuguauuuugaguuuuuuuuuuuuuuuuuuuuuuuuuuuaaagauugagccagguuugguggcacacaccuuuaguuucaggacuaagagguagaaguaggcagaucuaugugaguucgagguggucuacauauugaauucugggauagauacauaaucgagacuucugucucaaaaaagaaaaaaggcaaaaaggacaugauguuggauuuuuuuuuuuuguuguuguuguuuuuuuucgagacaggguuucucuguguagcccuggcuguccugaaacucacucuguagaucaggcugaccucgaacucagaaauccaucugccucugccucccaagugcugggauuaaaggcgugcgccaccacgcccgguccgauguggggcaucuuuaaucccagcauuugggaggcagaggcagauggagcuuuguauguauuaaauuggaggccaucccggucuacagagugaguucuaugcagagaaacccugccucuagauagagaaccaguccacccacagagcucuguggcugucaugcuuaguggucgcuuguuuagugggucccaagcaagcccuggguucuacccagaacaaaagucuaagacuuauuggugucuagaaauuugugcuuucuuugcuuuuuguaauaaaacuuggccauuuugucucaugaggaacuaacuuaugccuguuuuuguagauuuguuucaucuggagugccuaguacaaaaguugaagaauuuauuucuauucuuaacuaaaauuaagaccuuuuucuuucccaucuuuuacagacuauacccaacaagcaacucaaaggugaguauacuguuucuggucugaugcuagaagacagcaagggugauugaucuaacuugaguuuuauguauuucuguaugcuuuuguucuuauucuuuuaguugaagauuacuggucuguuuucuuguagcuacggggccuauccuacccagccugggcagggcuacucccaacagagcagucagcccuauggccaacagaguuacagugguuauggccagucagcugacacuucaggauacggccagagcagcuaugguucuucuuauggacagacccaaaacagugaguucuuaguagaacacaucuucauuucuuuaugaauguuaacuuuucuuaaaccugaacaauaccgaaauucccacauuuucccuaaaguuuuguagucauucuuuuaaaacaaaaauacugauuuguaauugauuuuauauuggacuauuuucuuccugcuuacuauuuuugugaaaaagcaaguuugcuaaagagagaaccaguuuagaaugacggauaggaaggaaauggucugcuugggaauucuugaaguuggcugacaaucugugauucacagagguggugccauuuuuaccucacaagggcaaaacauuuuucuuuccauaucagcacauuuaaaauguaguuagggccaggagugguggcacacacaacuuuauccagcacucugggaggcagaggcuaguagaucucuugaaucuugaguuggagaccagccuggucuacaaggugaguuccaggacagccaagggcuacacagaaauccugucuugaaaaaaacaaaaacagauuaaaaugcaguuuguaggaaucuuuuguguuaugauuaguggcacaggugucuagauuuaggacagauagaauggaauugaaccuuuauuaaacagugauauuagugacauugaagauguggaaugcugcuguaaucuuaguaccugggauguggcgguggagagucagggucuuguucauuuaggacugguucucaaccuuccauuagauggaauuagcuguaacccuuuaauacaauuccucaucuugugugacccccaacuauaagauuauuuuccuuacuacuuuauauacuguuaaugguaacagauauguucaaagaaagaggugucaccugacagguugagaaccacugauuuagaaguugaggcagcuugaauucugugagaccugucauaaaggauugggugggugggugcagagaugaccuagcagcugagacuggccagauacuugacuauauauuugaggauggucuugagccuucugauuuuccugccuccaaguguugggagcagaagcacguauuauaauacuugcucuuuuuguuuguuuguuuuuuugagacaguguuucucuggguagcccuggcuguccuggaacucacuuuguagaccaggcuggccuugaacucagaaaucugccugucucugccucccaagugcugggauuacaggcgugcgccaccacgccugacuauuuuuuuuuuuuuuuuuuaauacuugguuuguugaagaucgaaugaacuuguaugugugauaaguaaacacggucggcugaacuacaucucuagcucacuccccuuuugcuugagauagcuuccugauuuugaagaucaccgugaaacacugggcuagguuuguuuuaagauuaacaaauuugggcuggugagauggcucaguggguaagagcaccccgauugcucuuccgaagguccggaguucaaaucccagcaaccacaugguggcucacaaccacccguaaugagaucugacucccucuucuggagugucugaagacagcuacaguguacuuacauauaauaaauaaauaaaucuuuaaaaaaauuaacaaauuuuagcugggcgugguggcgcacuugggaggcagaggcaggcagauuucugaguucgaggccagccuggucuacagagugaguuccaggacagccagggcuacacagagaaaaaccaaaaaaaaaaaaaauuuuuuuuuuuaaaucaggaaguguauuuuuuuuccaaucuaauucuugcccugucucccuccucuuucucacuaaguagcuguguuugaccugaacuggauauguagaccaguuuggccucacacugaacagagaucugcuucugucucccaaaugcuaggauuaaaaaugagcacugcauaccuggucuuuuuuuuuuuuuuuuuuuuuaaauuguacuuauaacuuuuuucuuuguagcaggcuauggaacucagucagcuccccagggauaugguuccacuggaggcuauggcagcagccaaaguucacaaucuucuuaugggcagcaguccuccuacccuggcuauggccaacagccagcuccuagcagcaccucaggaagguaaggugguauaggagaggggaaaggccagaagguguuggugagcugcugggucucggauggacuaaaaguaaagcaaguguacuuuggcauuuuacaaaucauaauuuugguuuucauuguuucccauuuaguuaugguggcaguucucagagcagcagcuaugggcaaccccagaguggagguuauggucaacagucuggcuaugguggacagcaacaaagcuacggacaacaacaaagcuccuauaacccaccucaggguuauggacaacagaaccaguacaacaguagcaguggaggugguggagggggugguggaggugaggaaguagcuuuaguucuaucuucuuauucuccaaauuugcccauauccuaaaaaaguggcuuuuuuguuuacuugguuccuaauguuuacuguccuuucagugguaccauugacccuuuccaugaugcuucacaucccuucacuuuuguugcugaaaacugaaacaaauuuguguaugcuaagcauacaugacuacuaagcaccccuccuuacauuaaaaagcauucuuuuguuuuccuuacaggcaacuauggccaagaucaguccucuaugagugguggcgguggcgguggugguuauggcaaucaggaccagagugguggcggcggcggcggcuacgggggaggccaacaggaucgugggggccgaggcaggggcgguggaggugguuacaaccgaagcagugguggcuaugaacccagaggccguggagguggccgaggaggcagaggcggcaugggguaggugucucauaagccagggaguaccuucaguggggaauguugcauggauuuccuuugaagucaaucccuagugcaugguuaguauuguucucugggcauuauguaagggcuucaguuuguggccaguaguguuucuuuguauauucauucauucauucauuccuauuauguuuuugugagaacuugggagccaaaaaaucucauuuauagcucuugaguagagauuuggguauugguguauuuauuuccaaagaaaaagaauauacacagauacauauggauugaagucauuguuaucucaggcaagaaacuugggaguaaagacuuguuugcaggggaaaccuauucuauuccugggaaauauuagggaaacuuguucuguguauucccaugugucuuccaagggaguugguaauggcuaacuugaccucagcuucuaggaauuggcuauuuacucaucuauauucuguaguuacuugaaucaugagccugauuugcacuaauuugacuaugacuuugugugugacuugguucauuuauggggucuucugacugaagugugcagacuuucaggguaaaguacacuuuacagugguauucugcuuucucauuccacuguuuuaccuuuucuuggucaaacaucaaaucaacuuguccaaccggauuucuucuaguugaaguaaaaccuuagauuugauguuaaaacaguuugucaaaucuguuggugacuuugaagggaccuuauuauuucccuugaaaaggggaaaaugucagugguauuucuuuuuuugaagaaagguuuuuugaagaaaguagguaguuuguacaugguaaguauucagaggugggugggggcauucucaaaaccaugcaaaacuaugaaaaacucuuguugugugcguguguuuaaugcaaaacuuuaaaaagaaaaacaacuguuaugugacuguuaacuugcucugcauuuuaugugccacagguaugaaaggugacauugcaaaauacuccgcucuucucacaguguagaaggggugaccccgggggugaagggugauuuaaaaacagcucaguaguuaggauagggcuuagcugaguuugucuugcucuaaggggaaauugccuuugguuaugacuuuuuauggaaugggguugggucugcuugcugcuuucaaagcaaaaaccacaaaacaaaacaaugaaaaaucacguguucagggcuaucucagggccuggugugaaaugucuucugggaaauuugggguagaucuuuuaaaccaacugcuggguuguccaccacuugcuacaagaggaaaaaacaucuacgucagaagaacaaccaaggaaaaugagcuuuuuuuuuccagaggauauagauaaaacuuuuuaaaguaaaauccuuaacugugucugagaaauugcacacgugugugugauaagcucaaaggucagacaaggguggucaggaagggguauauuuuaguagccucuugaaucuuuuucccaaaacaacaauccauguuuggggaauauuaaaaaaaaaacccaaaaaaaaccaaaaaacaaaaaaccaacccuuuuguagccguuggaagcuucauguccuuucuucuaacuugucuucuccagcggaagugaccgcgguggcuucaauaaauuuggugguaagugaacagaguuuccaaaauucccaacucccagcaaugcuuugucugauuguucauuugcagaugucuuagcguguuaagugucaaagguuucuaaagugucuguagccaccuccagaaggggugggguagaaugccuccugcugccagaugugugcuaacuggaggccagcagggauaagcucuuggcagucugcuauguuacuaaauugguuuuacacaaguuaauaguauuauuuaguaggccucuugguggguguugccacaucuagcacuuagugaccacaccauccugggcaacugggggauguucuggaacauguggugccaacuuggcuuuaggauccuuuugaucaguguguccaaggugugugugugugugugcguguguguauguauacacaaucucccaaauguuuuaauuuagggagagggacaugaaauagugcccugcccugaagaugguaaaguugguguauauauauuuauauuaaauagugaugucaaugcaauucuacauauguacucagacaaauauauaggaacuagaucugggaaggaagguguggacuacaagaaagaucuugaguguauugcucaugggaaauaaccagguuuuacacagcacaaacuugaauucauggaaaaaaauggcaaauuugagaagucuccuaguaagcuggaacuuuucugguuuguuuaacaaaaugguuucuugauuugucuaaaaacacuuaaagccaaaggcuuggguucaugacuuaggugucauuguguacagguacaauauuuuuauauggugaauuuagauaaacauugguuaaagauggugucuggaaaaaaauaggcuguauuaugaaaacacuucuggucuguucccugggacaugcuuuuaaaauacaauaguagcuacuauguauguuauuuucauguugcuuuggggaaacaacaugguuaagaaugguuuucaagaugaaauuaaaaauuguucuacaaggguugucuuugguguaaaaguuuggagaaacuggauggaugcacuuuacauugcugguguugagcuuacuaugcuucucuugugagagaacagggccaaguuauguaugaguugguugguuaauuuaaaagaauuacuaauuccccuacccccaucugugcugaggacauuucccagcccuagcugggggaaaacagcauuuucuugaaguguguggcauuaucaauggggauucaaaguagcagaucuuaagaaagaggcccuugucuccgucuagaauuuucuccauugggaaggccucaggauaggguuuggagagaggcuggaagcaauuaccuaauacauuccaagaauuugcauuugauguuaauuuguugccuuaucuguccuuuccuguuagcuaaugguuccuuuuccuuguuuuuguuuucuuuuuuuuuucauguaacuaagguccucgggaucaaggaucucgucaugauucugguaagcccaugguuuuuauauaguauucacuuggauuuucuuagaaacaaaaaauacugcaaaaguggagagugaugggaggggcuguauaaaugcuagaaacccuggaucuggaaguuuagacuucagauucugguauuuauuauuucuaguacgucgugggucuugcuugggagcuguucuuuuaaaguugaugguguuuuaaaguccaaaaauuacuaaaccagacaauuuuuuacuuauuuuuuuggauuuuugagauggauuucucuguaugacucagaaauccaccugccucugccucccaagugcugggauuaaaggcgugcgccaccacacccggacagacaugauguuucguaccuuuauuccuaacaggaugaucucuugaguucaugucuaggccauccugcucuacagagcuaguuccacgacagccugggcuauacagagaaacuaaacucaguuuuaaaaaccaaaacaaagaaaugcacacauguaaacuguugaguaacauuagguggauaaaaagaccagacugaaagauguguuaagggaaccacuuuacuagauguuuuuugaugguauuccuauaggcuauacuauauuuaaaugugaaauuggucucauuccuuucuuuugauuuuuaguuacagucaucuacauaauuauuuugaggcaggaucucuacauagccuuggcugucuuggaacuauguagaccaggcuguuuuuagaauucagagaucuggggcuggagagauggcucagugguuaagaauacugacugcucuuccagagguccugaguucuaaucccagcaaccacaugguggcucacaaccaucuguaaugggaucugaugcccucuucugaugugucugaagacagcagacagugcucacauacagaauuaauuaaaaaaaaaaaauucagagauccacuugucucugcauccagagugcugauauuaaaggaguguuccacuaugcccuggcauaaaaaguuuuuuuuuuuaaacuaaggagucuagaaaugaaaguuuggaaacugguuuuuauauuggguguugguguuucaaggacaguaaugaguaaauguaaaauuuuugaaggaaguagauaauacuuaaauauggauuguuuuugauuauccaauaagauacuguguaacugguaagaauccugagcauuuuucuugaaagcuuuaaaaguacacauauaugguugguauaccuggcuaacuugucuuuccguuuuuucuucaaaccuuucuuuuaauguguuguugaacaagcagaacaggauaauucagacaacaauaccaucuucgugcaaggccuaggcgagaauguuacaauugaaucuguggcugauuacuucaagcagauuggaauuauuaagguacuugauaaacaguagguacuuccucuuaacuguauuacaggcucuuagauucuugccauuagaaacaagucuuagugaucucaguaguaaaaacaaucuuuggcauuuuuugagauuggaguauaauccuuuuuucaaaaauauauuuaaucuguuuauucccagcagagacaggugaucucugaucuagguucauggcuagccuggucuauaugagguucagaacagcuaggauuuuguagcgacugucucaaaaaauaaaauucaguggaauguugggauuuuaaguguauuccucuuauagcuagcaaaaccaaugguuguugcuuuuuaagaagaaaccacagaaagauaacaucugaugaagagcuugcucaaagacaguguaaaccauggcuagauuuaaguuacaugacaggaagaguaauugggaagagaggagccaaaguuuggaauaaguguuaggggaaagauggagguuugguuucuacaggcucugcauuuguagauagaacuaacuuuagaucaguuguauuuaauuugaacuuguccagauuaaaacaguauaacaaaacaacuacauaacauugcuauuuagguauaauuguaaguacugugacguuuuggugccuuguuggagauugagcccuaugaauuguggcagagaaaguacuguauccacugaguacauccauagccuauggagauauuaaagggaguacagugaauuguauguaggcuauauacagguacuaggccaagacuugcaugugucaucuaaaaaucguuuuuuuuuuuuuuuuuguuguuguucagacaaacaagaaaacuggacagccuaugauuaauuuguacacagacagggaaacuggcaaguugaagggugaggcaacaguuucauuugaugacccaccuucugcuaaagcagcuaucgacugguuugaugguauguauuaaaacuagggugggcuguggguuagggaagcagguuccauuuuguuuguuuguuuuuuuuuuuuuauuguguauggaaagauguuugauguucagacaaugacuuacagguaacaguucuuuuaagugguucauagggauggaacuugaguggucaggcuugucaucaagcaccuuuaccuguugagccaucuuggugugguuucauuuuuguucgugucccauuaguauucuauacaucuuuccaagaagacagucuuagaucuuuuggaucuaaguguuuuggaucugcaggucucagcauuuauuguguacaugggugcgcaugugcaugccauggcauaaguagcaaaccaucugggguaauuccuuuuaccauaugggcucauaggauugaacaugggucaucaggcuugguggcacucauaccaaguuaucuugcuuuuuuguauggugcuggaguucuaaaucagacccuuucauauuauacugcuuuuacagcccugucuccccaccccgucuuuugagacaggguuucucuguguagccuugacuggucucaaacuagagaucugccucuugaguacuaggauugaaggcaugugccaccacugaccagccccaaaaccuuuauagcuacuuguaaaauucuuacuuuuaaaaguuaaauuagccccuuaauuagcaccaucuuggggccucaugaaaggacucugcucuggagucagcuccaccacaccacagauguggacccuucucaaguggcacgcagcccaauucugagccugucuccuuguuugugaaauagaaacaggaguaucccauuuggguucuugugaauggcacauguuauaaaauauggcaaucacucagcccugaaccucauacagcauuagcgcagcaaaucagaauucucucauuuacucuccccaaacacaugggcucacccccuuccucuaauuuccuccccaauccaauucaaguaaauuugcuguugcgggagagggagugggacaccacuguguaaggagucuaggaauggggaauuuuccuggaaacugggagaagauuccuugaugcagaggcggcuaggaggaacaugagcuaaccaguacccccagagcucccugagacuaaaccaccaaucaaagaaaacacacggagagacucaugccuccagcugcauauguagcugaggauggccuagucagucaucaaugggaggagaggcucuugauccugugaagguucuaugccccaguauaggcgaaugccugggccaggaagcgggaguggguggguuuuuggggaggcagaggggcuagggcauuuucggaggggaaacuaggaaaggggauaacauuugaaauguaaauaaagaaaauaucuaauaaaaaaaguuaagagugaagcugggcauggugaugugugccuuuaauuccagcccuugaggggcagagggagguggaccucugaguuugaggucaccucaaauagugaguuucaugacagccagggcuacaacuccgucccaaacaaacaaauaguaaauuuccacaaagguuuucaaacauacuuaguuuugguuaaaucacccacuguuacuucuuaagguaaagaauucucugggaauccuauuaaaguuucauuugcuacccgccgagcugacuucaaucggggugguggaaauggucgcggaggccgagggcgaggaggugagucuuuuauauuuuucugguuuaaagagguuauggaacacaauguagaagaugauaaaaauaaguuuuauggaagagguaggcuaaccaaacuaaggaaaugauuaaugauugcaucuguacuaggacccaugggccguggaggcuauggaggagguggcagugguggugguggccggggaggauuccccaguggaggugguggagguggaggacagcaacgagcuggagacuggaaguguccuaauccgugaguauuuugcuuuuuuuaaaaaguucuugugugguguuaauauuuuaaguguuuggaaguuugcaaggucauguugucaaugggagauugaguuuauaguuuaccuaggaaggucaguuuuuaguuuuuggacauacuaucuuaccaagugcaugucuagaacuuuagggaguacagaacccuauuugucuuuuuuuaaagacaguuucucuuugugguccuggcuguccgggagcuuaccauaaagacccagcuggccucaaacuuaaaauauauacacccaucucuaccuccuaagugcugggauuaaaggcuugugccccaaucaccugguuuuuaguuaauuucccauugccacgauaagacaucaugaccaaagcaacuuagagauaguguuuaacuuggggcucaguuucaggggguuagaguccaugaccuuagugguugggagaauggagcugagcaggcaggcauggcaugggauaauagccgacaacucaucuugaggcaguaacugaggagagagaacuggguuuuugaagucagcccccuagcccaccuccuaauccucaucaccugggaacccaguauucaaacaugggccuaaaccuccaauugccauucaaaccacaaauaguagauacuaagagaccuauaacugagauuugaaguggguagauagugcaggcagcguaaugugcuggacagaaaggugaugggugaucauguguagauaacaguggaguaagacuuaauuucaaacaugaauuacugaaacuuuguauugacagcugaucugugacuaaccuaaaguguggaaagguugaaagguaauuguuuagguuuaauaacaacuuuuguuuugguucuuggugagaaauagguuuugaaguuuugugaauucaauuguaccucuuacaaauugccuuucauuucuuuaguacaugugagaacaugaacuucucuuggagaaaugaaugcaaccaguguaaggcaccuaagccagauggcccaggagggggaccaggaggcucucauauggguaagaagggagcagagcuggaacugagagcuccagaaagagccccacacuugagauuugcaaaggucacgggagggaagguagaagaauugaagaugauaacaugacuuuuuuucuagggggaaacuauggagaugaucgacguggcagaggaggauaugaccggggcggcuaccggggccgaggaggggaccgugggggcuucagagggggccggggugguggggacagaggcgguuuuggcccuggcaagauggacuccaggugaguaagucaaaacaaaagucaagaaaauuggucagagaucaugaggaaaucagguuucccugggaaagucagcuuagcugguuacauuuuugggaaggaagaagaaaaguucagaacccagucuuugaggcuguuuugcuuuaaagucauuuguuggguagcagagacuugaagggugugcauggguaggguaguucaguaacacguaaucuaacauaacuuuuucuuucaggggcgagcacagacaggaucgcagggagaggccauauuagccuggcuccugaaguucuggaacucuuccuguacccaguguuacccuuguuauuuuguaaacuuacaauucaggaucgcucauggauauuuuuuuuugggggggguggggcgguuguguguguaugugugugugugugugucagacuacccuaauuguaaccauaucucugguucccauuaaaaaacaucauuuuaguuaa

SEQ ID NO: 12135 - RNA, 35019 nt, Mus musculus
gggcacagggagcggcggggcgcggcgggagccugguggacccugcuggugcggugagcgggggaugggcguccuagagagcugcugggggacaggaagggugugggaugaugaguugucagggugccgggccuggacgggagguugggguacagggucuggacugggcccaggugauccgagugcggggcagggucggggcccaggggugcagggccaggaucuguuggucgaggccucggaguguagggcugggaccccugagucaggauuccaggccaaaacccgguguucgcgguguggggccgggauugugacuugggguguguggcuggggucgggcgucgggacccgggcugcagggcuaggaucggggguuggagugcagugcuaggagggggaaccggggugcagagucaaggccaaggguucgcgguguggguccgaaaucgggggguugggguugugguguggcgcugggauucgggauucgggguguagggccaggauuggaggcucaaagucccgggucgcagggucuggauggggacgucggagccccggguauugggcaaggaucggagguuucggacaccaaugcugagccguucaucccgucauuuguggaguagcuaggggugcacagccggucuggcucugagggggcgggcccuaggacacaggcccuaggaauuuuggacauaaagaaaggggugggguuucagagcaggaacccaggaugaagugcuaagucgguuugggguguucuaggucagagugcauaauuaugggucugugguagucagaguaccagaaccugggaaaagaauguagaccugaggccugggagaugcugguggggguaaggggacuuugcuucuagaaucuaguggaaugaugagggccugggggaagcuggugggccuggggagccugggguuccagaacccaguggaauuaugaggguccaaggaccuguaggaaguugguaaggcugagcagccggguuccagcauuggucucuaguccucaggacugggcugagaggccaacaucugaggaaaggccugggcaccugagggaaauuugcaauggggucaauggaaauccaagcgccuagcuugcuuccuggagcuaaggagccuggaauccagccgccccuccuccugggugugugcccagucacugcagagguguuugggccugguauguuccuuuguuuccucuugguccgugugagggauggggacuuguggccagggagaaggaauucccuguugugcccagugaagcaagcagaggcuuuagcccuuccuagugguuugcccuggcugcacugccugggccuugccaguaaguagcccaagcuccaguaaguccucaccacccaguagacccucacagucagaacuuacagcccaccccccaccccccucccccagcguccaccaggggucaggccucugcuggcucacccagagugagucaccaguucaggcccugagucaacacugcuucucuguuugacugagaagguugucaccagaaguuugaaggagggagaagcagcuuuugugggagcuucagauguagaagagugcagaggugggguugaagaacugauugugguacuaggucuccagagcacccugggccuugcuagacagcuucuccacccaacuuuagcccuggcccuagagcugaccuuuaauugagggcuuaugacaguuaugccuuuaacaccuuguaaaaugccagggaauuuaauuggcccuucagacuuugaccuguuagucgggaaggcaccuggcauaacuccgcaccguccugagcauccuuaccuccuugugccccuggucuuuguccugggcauggucgugucugccuaccagcuugucucuuaauggaguccugggcaggcuagccuacuccgucugugcacuggccuccauaggcaugggguggggguugcccuuuccauaacaacuccugacccagccaccuuugcuccgcugcgcuauagguaucagguucagggccucaagaugguggauuccuccauccugugacuagguccucucugacugagcuucgugcuggcuguguggggcugaguggcuuucucuguccccgucugauuucuaucagcuuuauugauauuucacccuacacgugaucacccgauugaaggguucagugguuaucgauguauucagaguuguacagccaucaccacaaacaguuuuggccuucucagagaucuacauagaaugugcaugcccauggucccaguggcugggaaugcugaagcagaggaccuuaagaccaaggaguucuggccagccuaggaacaaaccuggagucugucugucuguaugugucucucuuucuacuccucccucccacucccuuuuugguggugguugggaugcauuugagacggaucucuauagcuuugauuaaccggaaacucacuacguacaccagcaugcccccuacacuugcagccauccuccugccuccugaguguugggauuauaggcugugggcacacacuaucaagcugggccgcucugcucuguccuuuagaaaagaacgaaacuggauaucuuagccucgaauuuccccugauuagcucuccucucagcccuccucccacauugccagcaccccccacaucccauuugcuggggaucaaguacagagccucgaacacacaaagcuuguauuccacccaugagcuccagcccugccuuuuuccuccguuuccuuuuuuguuuguuuugagaugagauccuuccauugagcuccuauguuuaagugucauucccccaguccccuaucacugugccuggcaucuuuguuauuaaacagguuagcuaucuuuuuaacuaaugauuaguaagugcucuuuauauauucggaauccauuauuugaaaaccauucuucuuccacaggucauccugucacguguuugcuucuuggcagggucucauucuguaguccaggcuagccucaaacucuacagccuccaccucagcgcccugagugcuggguucuaguuuauaugcugccauacagguucuuguugguuuucuggugguuaucuuuugaggaaccaaaaaacauuugagcauuuagaugagaaggcucagugggcaaaggacacuugccacugagccugacaccuugaguucagucccugggacauauguggcaggaaagauucaggcuaucuauccuccgacuuccauaagcacaccacagcacacuuguugcuccacagacccauacauggacacaaacagacacauccauacacauagacacauaaaggcagacagaaagacauacacagaguacuucccaguguguuuauucuguuuuuauauccuuguguucuuuuuuuuuuuuuuuuuuuuuuuuuuugguuuuucgagacaggguuucucuguagcccuggcuguccuggaacucacucuguagcccaggcuggccuugaacucugccucccaagugcugggauuaaaggcaugcgccaccacgcccggcuguauauauauccuuguguucuuaacauaacaucugagauguuaucagcaaauugcagucagaagcauucauguucauuucaguccuuuggugugugagagauggguacaggggccuuauuuagaucccagauuacacagacuuauuuuucaguugguuguuuucgugguucugaaguugagaacauugagcauacagcuagggacauggcuggguugcagaguguuuguggaguaagaccccggucucaaccccagcauugcugcucacuggcuccauaucuggcuuuccacauggauucugggaucaagugcaggucaugaggcuugugcagcaagcacuuguaucugcugagccaucucccagcccugaugaaugggcugugacuaguggguuuuuuguuuguuuguuuguuuguuuguuuuuuuguuuuguuuuguuuuuuuaaagguggucucacauagcccaggcuggcuaaggaugggaguuauagaacucuggucccccugccucuaccucaaagcacuaggaucgcaggugugugccauugugcuggcucauguuuuagcuuuuagaggcaggcuguccugucucugccgcagcuggagucauaggcgugugcugccaugccaggcuucgguuucuaaaugcagugacagaguucugucgcccuccgccuucauacauuagaaugggaaagaaauguucuaucucagcuguacagcgagcagggcaggugccgaccacagaggcugagaucucagcugcauuugggguuggugggggggguuggcuaaguauggggggugaggucuuugaaucugcggaguccucugguuccugugggcucuaguuagaaagaggcuggucuuccuguccgcugauguaauuauaggcagcuuauauauauauaccugauuuuugcuuuuuugagucaggguucuucauuggucuggaaaucacuaaguaagcuauauagccuucucucucucucucucuauauauauauguauauauauagagagcgagauagagaaagcaagcacucggaguaucucuaaaagugccuugcagggcuugaggugagguugcccgaauagccugguacaggugugcugagccuccagucuucucuucauagguaaucauugaucaucgcagaugcccucauauuccacuuuggauuccuuggauucggacagacucugaacugcuuuucccagcaaaagagaaagguuuguguguugugacagcuccaguaugcuuucucuugggucagauguagaaagggcucucuuccugacucugcagggagagaccugggguaagugaggguacaauaaccuuugcaaagaaaucugaugcugggaccuagaaggauaguucuguagguaaaauguuugccaugcaagccuaaggacccaaguuuggaucccaagcauccaaguaagaguugggcacacaucuguaaagugcugggggcagcaagaggcagaucccuggaaucacuggucagccuagccaguugacaagcucuggguucaguggugagacagugucucaaaaaugaggaagaggaggcuagugagucggcucaguguguaagagcaucacugccaggcuagagagcuuaaauccaaccucugggaccuguauauggugaaggcaagaguggcaggugcugugaucacagcccguuaagggcuggggagauggcucaguguucaccacacgaaugugaguucugagccucagaacucagguaaaugccaggugggccuggguaggagauccaaagagcaagcuggcuggugagacuagccuuauccaggagcugugggucugacugagagauccugccucagugaauaagguggaagagugacggaggacacacacaugggcaugcguguuuaugauuugcagacaugaguacucccccaaaaugaaaaaaagagaaagaaaaaucuugucaaaagugggucaugucuggaacauucuuugcccacaggauuugccgucucauuaccagcuucuaaugugaggaaggcugcacugugccccccaaauugcaaaccugcccuucaccaagcugcuggaggcagguuacuggccugguugcuuaccuuaagacagccaucauaguccuaggaacucauuaaagccaagauaaucuuuuuaaauugugguaaaauaaaacauacauuugccaggagugacacuuaggguauaccagaacugcaugcucccugucccugugcugcuccuggagugugcagucacccuaagacugaucagggugagguccucauugguggagaacaugcacaccccacuuuguugauuugaaauggaguccuacucugucgcccagucuggucuggccuuaaacuuauagcaguccuccugccucagccuaccuacugcucagauuauagguguaagucaccgaaccgcuuucccuuuuauuguaggugugaguguucugucugcacguaugucuauaccacauguuugcagugcccacgagggcccagagaaggcauuggguccucuagagcuggaguuacagugagcugccgcaugggugcuggcgacugaagcuugguucagaagcuuggaagagcagcaagugcucuuaaccucugagccauuuuuccagucccaaccauguuuuuugguuuuuguuuuuuugaguaaggguucuucauggucuggcagucaguaaguaggcuaggcuggccagugagccccucagauccuccugccucccaggccacuagaguuacaaauguccucaucacaaugagauuguuuuucuacauggaugccaaagcaagccuugcauggagcugucuccccagcuccaccuucaggacucuuuuuuuuuuuuuuuuuuuuuuuuuuugguuuuuucgagacagggcuguccuggaacucacuuuguagaccagucuggccucgaacacagaaauccgccugccucugccucccaagugcugggauuaaaggcgugugccaccaccacccugcuaccuucaggagucuuaauaugaagcugugauucgugcagguguccuggaguucagugacuguccucugcggggagguggcuuccuaaggguuugggucaaggcuucucuggagugcuggggugacucuccuaggugacucucugccgcucuugcagauguggaaagccucugcaggccaugcuguguccaucacgcaggaugauggaggagcugaugacugggagacugauccugauuuugugguaggagucaccagccugcuuugucuuacuggcuguuugccucugagguucccagccugccccugcacugagcugcauaauuuccuccagggcacagggguacagcuuagacguacuaguuagggucugggauauacuaauuagggcauaagauaaguaaauuagggugccagguguacuguuuaggucucagggcauacaaguuaggcaugagaguacuacauauuucucuaggaugggaauuauaguauuuaggguauggggugugcuaguuaaaaugggggggaguaugcuaguuaggguacaggaugugcuaguugggcucaagguauacuuguuaaaucauguauuaguuugagcucaggguguacuaauaggguucaggguauacuaguuagaguacagaauguacuaguccucaggguguucuaguuagggcauguaccacuggcucuuccaggguagagauacacuaguuaggguuuagggaaugcuuuuuuagggugugggaugugcuaacuucuucucuuugcagaaugaugugagugaaaaggagcagagauggggugcuaaaaccgugcagggaucggggcaccaggaacacaucaaguaaguaccuuauggcaccccacucucccacacaccgugcccauagggugagaucagagcgggccucccugccucuccaggugaagaucguuaagagucuaguguuugugcgugggccuaaggugucaggcacacacagauaauggacaggagaccuagccaugucuuucaacacagaacacaguagcauaaacucuucacuuucaguggcagcugcugagggugugggauggcuuugaguaacuuggacccuaaccaucuucauuuggaucauugucuacaaguugucuccuggaauuuagugcuugaccuugggagcccagcuccaaucuuguggaauguaccaugcaucgagucugacccagcaccuucugaaaugccaacucuacagcagcuugcaucccugucagggagggcaggcaggcccucugcagacaccuagaugcuguuuuaggccccaaaggguuaagaacacauccuguaugucugcuuugguauuuuggcugcgguaaucagaacguuugacuaggugcccagaagagggcugugugguggcuuggcuuguagguggauuuuuuuuuuuuuuuuuuuuuuugagacaggguuucucuguguagcccuggcuguaccuggaacucacucuguagaccaggcuggccucgaacucagaaaucgccugccucugccucccaagugcugggauuaaaggcaugcgccaccaccgcccggcuuguaggaggauuguagcugauauuuuuaucuauuucugagauagaguccugcugaguuucccugucuggucccaccuuccaagcucgugacauucuuucccauagugacuuucugaaucugaguguagaguaacccagccuaccauggaagagguuucgaguuucccugguguaguagaagaggggauggauaugaggugaacagggaucugggcagccaagugccuaugagucuguccccaucguuuuagaacaugaugggaagggugcaugggaacacccauguggcucucuggauggaugaagacuccagggggaggggcauaugggagucccaugcuuccucucagguuguuggugguguuucucuuuugcugcucaucaagaucggugguuccgggccuggugugccucuguccccacuuucgagcuuguucauaugcagagcuguggggccugugucugcugcucaggaaggcccugugacacagcgccccagugacagcuguuugcaggcagacagguucuggcgcuccucaccuguacaccauugcugcuugucuuaguuugcucugcauugcuaugauaaagauacugaccaaacacaaccuagagagaagcaaaggguucuuuucaccuuccagcuucuaaguccaucacugagggaagccagaucaggaacuugcaggcaagaacuaaagcagaggccauggaggaagacuccuuauagcuuacuucucaugguuugcuuggcugcuuucuuauaccacccaggcagaucccaggggcucucccagcauuaacuccgccccccagugggcuauguccucccauaucagucaucaagaaaaugcccuauaguaggucagucugaugggggcauuuucucaguugagguuuccucucugagaggacucuagcuuguaucaaguugccacaaugcuaaccaacauagccagcuccuucuggugaccuuggggguuuguagaugggacucuaggugacauuuacagaaaucaacccucuaucugcugaucuaagugaagggaagcucagcugcgcugccucugggacuggccacaugguccuguguggauuuagacccauauuccucccacauacagagccuuggaggcaggcacagugaacaaacaggacagcaaucucgcugacucacaagggcaucuguauuccuguuuguccugcugucgggugaggugcaugccuggacccugacauggcccugcuuuuccuccccuccagcauucacaagcuucgagagaaugucuuccaagaacaccagacgcucaaggagaaggagcuggaaacgggacccaaggcuucccacggcuauggcgggaaguucgguguggagcaggauaggauggacagaguaaguggcugaccgggcugagcugcuggccugcaugggugcaugauguggguggcagucagacuuuuccugagucauaguguagagugggguuugcugagggugagggguugcucugaggggucuucuauagcugcccucugguaaaguucuucugugucucuaguagcuguuuuacauugucagaggccccagccaguggcuaguauguagggggggcucucugggagagaucagcaccaugaccggcuuugugagcacaacagagucuggaagcauccgucucacagacgucauugucaccauggccuaugguugagaugggcgaagucagcucugagggcccuuagcucccaucacaucuguggaguccacugacgcuuagcuuauguccuauuugcauuugugggccacucuguggccagguggggaggauguccauccugucucagcugugccugagccccugggaguggcaucaaugguucugacugacaagcagaugcugugggcauuugcugcauaaaccaucagucugguaguguuuugcaucuucuugccccaagaugagggaguggagccugcucuggcgcucacucuaggcuggcugguuuuuccagagagaaaguugcaguaugugagugugucuccugcagagcaggccuuugcgcucuguugaugcuguaacaguguaguccugagugagccguauggggugguucugaugaguagacagugaugcugcuggguagacauggaagagaggcucagcugcugccugucugaugggugacucccucacacauggauuguauucagcuaugcuaggcacagaaggccaugaccgugucucaaggagacaccacuguccauuagaggaguggacucauuagccugcgggcacccugacuauaggcugugaagagacaccaugaccauggcaacucuuaugcaggaaagcauuuaauuagggcuagcuuacaguuucagagguuuaguccauuaaucgucaugucagggaacaugagcacacacagacagacaugguccugaagauuagcugggaguucuccauuuugaucugcagacagagagagugauacugggccuggcuugagaauuugaaacccuaaagcccacccacugugacacacuuccuccaacaaggccauaccuaacaccacucucuaagacugaaauuucuuugugcucaccugucuugaccucuguuuccuucgaugaguucucauugcuacccugugcugccauucuggggagacaugcccuucugagcuugcccuagaacucacuacccucacuuugugccugacuggucuucugugcuggguacccugugcuguaccuguguacugccaccuucuguggcugacuacgcucaggaccagacugcuccuaaaaacuucaguuuaccucagcuauugaccagcuggcucucuagcagugggugacauuagccaggguguuccaucuuguuugaccccuuaggcccuguacauugaggagagguuagcccuuggcucaugugaacaccugagaauaaucuguugucaaaaaccugaacacgaauggcugagcuauucguagucugucuucucuagaaacugaaaacaugugaauuccagagacuuauucagccagccucauucaggguagcacauaccugugagguccagggcuggagccaccgggaccuuuagggaucaggcgauuguggccugccaaggaggcuucuugccuucucugcaugaugcuggucaaggcagauaauagauaugcuucugccaauagaagaccagaagcuguugagcgcacauuccagcagagguuggaaccagggccagcugucacuucagcccaguuuucucuuuaauuucuuucugauggacaauccugccaggaaaucucuuuggcauggcugccucuuuuugauucuucacugacagcuucugugugggagccuaaaggccaaggacaggccacagugccacaugggguuucauaggcuguggcuuauggucugccaucagcugaugaccacagugaagccugggaaggagagagugauucagccaagguuuucucuguagacaguguucugccuauuacacagaccucaguggcuuugaagaagggcguugaaguuggugauaugcagaacagggcccaagggcaaggccaaacugagcaguuggccaaucaaccaagagaagucuaugguacacagggcugacauucucuguagggcacucaguugggguucuguguugccaggaaggccaauauagagagagucucuaauguacuguguggaagcauccccuguaaauaaaaagcugauggucuaguagcugagacaggaaguagaaggugggacauccagcagagaagagguaggauucgagaagucaagagcuggaagauucaccucagagucugaggaagauggauguaugaaagguaaccagccacauggcagaacuuagacugguuuaaaugggauaauugaguuccaagcuagugggaacaagccaaaacuuagggccuaggcauuuaucaucaaauaagccuccaagucguuauucaggaacuguagguggaaaagcccaugguuacaggccaagaagccagguucagaggcacagggcccucugcauccccacucugagcuguccuugucuaggaaggagcuacacagacaucauccaucaugagaaaggccacgggacugcuguggugggcagcuggugacagugcagauaucagcacugcuuauggaaggggcuagggugucuguuaggcuguggguugaugccccuugcauugccuauugguaggucuauagccuugaacagaaggcccugcagucagggaccugcagccuuuggugagggcugauaggaggcucuugugcagguaacagcccuuggcuccugccaguguggucugcaugucugggaggugugguaugcaugugugcauugccacggcaguaccuguaucuguuucaguacagucacaaagugugucuccuuugacucuugggucauagcccugaaaacaccugacuuugagagagugauugaggaaaugggucuuccuguguauacuucaggcucuguccuuuguucaugucugauccugucacguuccuaccugucgucagggguguuauagaggaucucuagguuuggggugcacaguggaacccugcaccagggcucagccauuuccaggcuguguccuggaagucggggccccucacugacaagggugcccuccuuuuagccucaaguagcugcagcaacagagcugggggguaggguugcagugccacacugggcgugggugcauaaugccgcaucuuuauucuuuguccagucagccgugggccaugaguaccagucgaagcuuuccaagcacugcucacaaguggacucgguccggggcuucggaggcaaguucgguguccagauggacaggguggaucaggugcgugauggccaggacugccggcucccugcccagagcuucaggcuguacuuguggcugcacuuuugggucagugcagcaguucacagguagccucugacuccaugggacuguaguaagguuguuuagguaagaauuuaaaugagcgucucugaugcuugccucucugaccuaagugaaggaugcugacuaucuaauggagacuaggcagugacauggagugauaggccuccgugugcuuacugcaggccucccugugugcuuagccucugacucagcuaugguauaccaucagggaccuuuuucauugucuuccuuggauagaugugauugauaggguggguuuacugaacugcggucuuaaaguccagaggcucuguaguaaaccugaggcuguucugauucucucagccugggucugucaguagagcagggcagcacacugcuuucaguguguguucuaacucuaagacauaguagcagggucugaccaucauguccaaagugugagagguacggagccccagcuccggguugcacaggaagcagaauggaugaugaaggcaggccugccaucuuguuaauguucucaguaaagcuuguuccggaaguccauguggcaggggaauuaauuccagaucagcaugcugugccuggaauaagucagccaagcagggagccugugggggauggaggauucuguacacacagaccgggucagugaugauugagucuguaguuugacugugaaaccgaaggucaaaaaacaacauuguuuaagccuggcucacaccuguauccccagcaccugagaggcagaggcaggaggauuaccuggaguucaaagucagucugagccacagagugagacccugcacauuaacaaacagaaauccaaacacucaaggauggggaggcggcucagaccccaguguggaguggggaggagacaggaggauggcuaacagccuagcucuccguucagugagaccaucucaaaggccuaaagaaacagugauagagcaggacacugggcagccucuggccuuuauauguguggcacacacaccuaaccacauaacuaaaagcuuuguucuuugugugccaugaguucagauggguugucuccaugguccuauuuaaaugccugucccuuuuguuuccgucccacagucugcuguaggcuuugaauaccaggggaagacugagaagcaugccucccagaaagguagggggagcuggugcagccugguggggggaggcaggaaggccucugcucugugcuuugaccucuagggccaucuggcuguggcagggccugugcccucgcugucugugguguacacagagccggcugacuccagaggaagcugccuucucuuuaccugagcagcucagcucagucagcucuguggcauuguggaugaacagcacauacaaauguuccuggaagacagaaaguagaguugugggccuguaguauccauucugugcccugaagcguggggaagaaagugcugauuggguuucaugaugucacaugacucuggagcugcuuuuuuuguuuuuguuuuugcuuuuaaacugcaaaggcaaauuguuucuuuacaguacccagugguuugguuugguuuguuucuuuuaagaugauaucaugcuaucaugccauugauacugaacaauugaacugaacaguucuccugccucagacucaugagugcugggauugcaggcaugugacacuucaccugacugucauuuuuguuuauuuuugagacagggacucauucuguagccuaggcuggcuuaggcuuuauuuugaagcccaggcuggcuucccacuccuggcaaucuucugcuuuagucuccuguguacugggaccgcagcugggugcagccaugccuggcuguggccagugagauuuuucaagugggcagacaccuuuauuucuuuguaccccuccccacuauuuauuuuauuuaaacauuuuuauucacuuuguaugugcagagaccagggguagagagaaguucacggaggucuuuccucuccuucugacacauggauucuggggaugagcucuucaggcucgguggcaggcucuuucacccaugcugccgucucagcagccccccuacuuugguuucuugaagcaggauugcacaccguagacccggcugagcguucccagugggaacugcucuggccaguucauucucucaauacaaaacagucuccugcaaugguggggugugagcugaacucugucugcacaguuuguggguugugccccucuccccuuucuccuuggagguucuuggccaccagccugaagggagaaggggagcugagguggcaaagagcaggguucagccaugagugugucugggaugaccucuguagacugcuucagcgagacgaggcuauuguuuuagggauaggguauguaagagcaucuuuagggcacaguggaugguuggucauggcaucaagcgagcaggaagggccgcuugguuauagcacagcaccugauugucaugcagugggaagccggagugggacuucugggcugaguuaugcagccuugcacaaagcucugaacaaggucacuuuucagacauggccagccagagccagccaccugugcucagggacacucucaggcagagacaggcagacaggggagccccagugagaaagggagucccccauuuuaugcucagaaaaccacccagucauggaggacugcuaccuuaauaacaagguuccccaacagagguguccaaggucauccuaaagaaugcaacccuuguguuccaaaugaacacaguaugucucuugggagucuuaacucaugcugacugcugucuugucuccuuagacuacucuaguggcuucgguggcaaauacggugugcaagcugaccguguagacaagagugccgugggcuuugacuaccagggcaagacggagaagcaugagucucagaaagguucggcgggccuugggcuccuuguggaugagugcgcucuuuuuuugucugucugucuguuuuuuguuccuguguuucuucuaaucuuuucauaccucaacuuuucuuagacuuauuuauuuuuauuugauguguaugggugugugugggugcuuuguguacauguauguaugugcuuuguguggaagccagaagagaagcuacauuuauaggugguuaugaguggcuaugugggugguaggagccuaaaaagguccccuuaaccacugaacucuagugcaucaguuuucaaccuguggguugugaccccuuuggggucgaaugacuuuuucaugggagucucagcagguauucugcauaucagauauguacauuacaauucuaaacaguagcaaaacaguaguuaugaaguagcaacaaaaauaacuuuauaguugaggucaccacaacaugaggaacuauauuaaggucacggccuuaggaaggccaagagccacugcucuugugccuguguuuugagacagggucucauuuuguaguccaggaguucaccauauaaggcuucacacuugaccccaucuuccugcccagcccaggugugaguguguguuggggacaugcaugccaugugugaaugccagaggacaacuucguggagucacaucuucuaccuguuguggguuuuagggauugauuggauaucggcaggcuuguguaguaaacaccuuuuuguguuuuguuguuugagacaggaucucuauuguguagcaggcuguccuggaacuugcuauguagacuuggcuggucuggaacucacggagauccuccugccucugccuuacaagugcuuuaccuugaacuuagacaugcugagccaucuugaagucuccaugcccccucccucccaaucccuucuuuucuuauuuuuaaagacuggguuucacuggguaguccugauugucuugggggcagggacugggaguguauauagcucaguggcagagcacaggaucuggauuugagcaccacauacucaaaaggcccugcuaggccauccuggcuuuuucuccuucccugcuguauaaagagcaggcacauguuuacagauaccgcugcacauuggucuuccuggugcuguuuguuuuuugugcccacaugaguuauuucuguuuaguguuuaccaguauuugaaaaucaagagcuugcaugaaaaagaagcccuuguauuccccacccccaccccccuuuuagauuuacuuauuuauaugaugcucugucuacacaacacccgaaugccagaagagguuaucagaucccauugcagaugguugugagccaccauguggguacuggggacugaacucugguccucugcaagagcgucagugcucuuacugccgagccagcucuggcccuuucuguuaacugccaagcugucucucucuggcccuuuucuguuuuucuuuuuguuuguuucuauguuucauuuuguuuuuguuuauuuguuuuuuuucagccaaggucucacuuuauagcuuugaacucaguguguauuggcuuuguuggcuucagauccucagcaauccuccugcuuuggccuccugagugcugggagauaggcaugagccaccgcacuugggcucucucuucccaccgugucagucccagggauugugcucaggucaucuagcuuagggacaauugccuuugccugcugagcuaucuugacagcucacaacucuuaaagaccauauaacaugucauuuugaccuguugcuggcuuaccuuuuuaauguuuauuuuguacaugcguaugucugugcacaugugugacagucagaggacugcuuauaggaguugguuuucuccuuauaccguguaccaugugggucccagggauugaacucugaccuucaaauuuuguggcagccccucccccaccccgcucuccccuccuccccccagccuucuaacccacccguugcuaguuuuuccuacagugcuguuguuguuucagauuacuccaaagguuuugguggcaaauaugggauugacaaggacaagguggauaaaagugcugugggcuuugaguaucaaggcaagacagagaagcacgaaucccagaaagguaccugcugcuuccuuccucuagccagccccucccaggaucacaggcguggccacaggagaagagaaaaacaggcugucaccuacaguggucagccuaaggcggccggucccagcccaugggaacucacacaguggccucagcuuugaccccaagccccaguguugcuuguagcaguguccugucacgcacgucugccugugugugaugagaccuccaugccucgagggccgcaugcauuggcccugccuguugaaccgcacuccuaagaugcgauuaucuugaggagggccucucaugggugucagccaggguccagugaagugugucuucuugcaucugaaacccaccuccucuuuguccugggcugugcaguaaugcugggguauggcuuucuguugugcaugcagacuauguaaaaggcuuuggaggaaaguuuggugugcagacagacagacaggacaagugugcccuuggcugggaccaucaggagaagcugcagcugcaugaaucccaaaaagguaccuccucuagccccacucccugcuuucuucagggcccucugggacgcucgugucgucccucggugggucacgugcuucaugucagccgcguuucugucuugaguuuuguucucacgaugugaaguuguccaugucuccacuaguuccagaaguccccauaggcagcagggggauagggugauccgucccaucucaccccaugccaaggcugcagccccugggagccugguuacugcggcacccuuggagggguccuuuguccuccagguuccuggguucuccuuuauaaggugggcucugauauguggaaggcacacuuuuuuuuuuuucuuuuuugguuuuucgagacaggguuucucuguguagcccuggcuguccuggaacucacuuuguagaccaggcuggccuugaacucagaaauccgccugccucugccucccuagugcugggauuaaaggcgugcaccaccacgcccggcuugaaggcacacuucuuucugcaguucuggagauagaacuccaggaacuggucugugcugggcagggucuguaucugagucucccucaaauccuugcacacuucuguucuaauuaggaauuuuucuugucacagugggaacucugucccagggaaagcugguuugaggaggguaaaacccuguagcuguauucagccgucccuucaggcaaaccuugaagccuggaguagcuuuaacuaaacuuuaccauccaguucugauccugcuucugcgucucagcugaagucuacugaccuuaaguuuguuuguuccuuuacgcuuuggucaauguuagaucaacaggcccagaucagaggucugaacaugacguacuggaccagugcgcguguucccgugauucuaaccuagcugucuccucucucggucaugcuccucacugucucccguggaucuccagacuauaagacugguuucggaggcaaauuugguguucaguccgagaggcaggacuccuccgcugugggguuugauuacaaggagagauuggccaagcacgagucccagcaaggcacaguucccccccacccccacccccccaccagcccuugcagugcagcugacuuggagcagacuucaggguuuaccgcagugccugugacaguucccugugccgccagcugccagcgauggccuccacucaagugucaugcuagagcaacaucccggagcuugguccuuuuccucccccaccccaccccuguucuuuuuuucccuccagccuucuggguugagguuaggaggcacucugcaggccagguugguauaguaucugcagggaacaccucuggccucaucgcugcagacccccagcgcugacucucugacccauagggaguuggguuugcuucucucagaccugauguuaaccacacacuggggugguggagaaugaaagauguguuucaugugcucccugugucuuuguuuacagagguguggauuuuuguugcuguuuuuuguuuuuuguuuuuguuuuuguuucuuuuuggccagguauacaagguuuuauguguguguuuguuuugguuuuuggccacacggacuuguguguaguaucugucuccacccagagccuuacccuagugcacacuguguguggcugauacuggcagguggaggcaugcccuggggaucucagaagcuauugcaguuuuucucuuugagaggucagaccugguucccagagccaaccugguuccuagaagcugagcacccaggcagaggccugugacucccuggaucaggguggacugugggcucccagaugccaucaggcccagagugaauguacuuggugcuggcccagcagauuguguggagguggccauugguuccugugaugucaaggcugcaugacugucacuuucauguguuuguguguggcagcaacagacauacuugucugguggcauuuccacacagaguuuuuguuuuguuuuguuuuuuguuuuuucuuuuaaaaagcaagagaacaaaccacgauggggccucuaauuagugcccaguagagcaggcgcccaggaagcagaugagaauaaggcccuggcuggugcgaagacugugcuauagaagugugcacugcaaaggccuguccuguguccucccuccuuggcuuccuucccgcuggccugccgcccauccccucccuguccccauuccuggaagcaugcccacaccucuccuacucccugccugcacugggcacugugguuagacagcuggcucugccaggagagccuguccucgggcagcuuucacgucccuccgcucuggucuguguccccgggcuguuuguggauccaugcgcaugugccugccacugcucgcccauccucagccucacguaagucucaccuuuaccaccuuuuagacuaugccaaaggauucggcgggaaguauggggugcagaaggaucggauggacaagguaagacuggugagccaugguggggaugucuuccgagggccguuggcucacuacauggaggucuguccagugacauuagguauaucauuccauggcucuggaguggccaccugggaacccugcauaccucauguggcacacuguggguucauucuguuucacauguggggcugaggccaaccaagcugaguacuuggucacagcacagcaguuagcaggagggaucuugggugaaauugaggcacuugauacaagggucuugggaccuauuugaccuuuuuuuuuuuucugacgcuuuauuuauuacguauacaguguucugcuugcaugugugccugcacaccagaagagggcaccagaucccauuauagaugguuaugaaccaccauguggugcugggaauugaacucaggaccucuggaagagcagccagcaagugcuuuuaaccucugagccaucucuccagccugacuauuugaacuuuuuuuuuguuuguuuguuuguuuuuuuuuuguuuuguuuuuucgagacaggguuucucuguauagcccuggcuguccuggaacucacucuguagaccaggcuggccucaaacucagaaaucugccugcuucugccucccgagugcugggauuaaaggugugcgccacuacugccuggcuugaacuuuuaauuauuagcagaaagccaggcaaaaaccaguucucagaauugcuuaguggccacauuuagucacugucuguuaccacagacgggggaacuggacuacuuacuagucuuguugcagugggccagcaccugggacauccugggccuuagccugcccuuuuucacuuuuuccuucagauaggguccugcugugccacccaggcaggccugggacuugaggugcuucugccucggccuucggggucuggcauugguggccagugccauccuguccagcuuugucuuuuagucaugaaagcguguuccugugguaacagauugcuccuucucuccagauccccucaucagccuguuguugcuuuuaaucaguuccagaacccuguaaggucagcugugagcuggugaaaguuguuuuucuaguaugucagccagugguggggaaagcuauugcuagacagcucuguggguucuccaguggucuggcaggggcugcuuuccucugccugaggugagcugcauacucucaacugcacagaugccaauguuccuuccugcccuugacuguggucacacauggcgugccugggucauccccugaguuguucuuccuuuagacucagcucacugugguuggcuucauccugggcaucucccaggucaccaggguaucucacaggagaccccuagagcaaagcugguggcuugugcuaacuggcccugaggaagcaagaugaacugaguuuaagaaugaugauauguagucagguggugugcacaccuugaaucccaguacucagguugcagaggcaggcagaucccugaguucaaggccagucugaucuacagagaguuucaggauagccaggccuuuacagagaaacccugucuccaaaacaaaaacaaacucauuguguguaugcauguauauguguaugugccaccaaguauacuugguagucaaaggacagcuugugugaguugguuucuaccaugugggucccaggguuugaacucgggacacugggcuuggaggcaagugccucuacccagugaacccucucacuggucccugggcugagguuugagggcagauggucagugacaaagcagaggaugggacaggagccugcuuugggaacaaggucauugcagauauggaagagugaggguggcgauucuauuuccugcugugggggaagccuauggaacauucagccuuuacugaaggagccugaguccgggcacagcugcacacaccuguaacccagcacucgacagagcagagggcgggcuuggugugauuccaggcagugguggaggcuugcagaguugggggacuuggguagagaagaugagagugauaaggccuuaggcagccaggaugcugcaaggcugccucaguggcaggggagggccaugcagcaugcugaggggcaccccucaggguuuuaccucugccaguuggaauagacugagcaaggaggcuggguaagguggcaggagaccaggugugugguggcugagagcccuguugcagaagacauaaggaacuaaguguguuagucagaggcuggcauugaggaaguuguggugucugugguuaacagugaugguaaagauggcgaccacugaccuugugcacucguagucaggaaaugaugugguuagcauugucucgucuccccaccuccugccagccaggcauggccauucucucccugucuauuguccuauggagaugcccagggaacugugggcaggaucaaggcccagcuaugccacgaggcuguucugagagcaguguucaucccgauagugacuaggauaaggugguaaccucgauaccagccuguccucuccuggacaggaaaaguguuccucuguggugccuugggcagcugcaaguuguccacggacaagaguggccacccuugggcuccagagccagguucuguggagaaagggccagagugagggcugacuuggcaggauggaucaagggcugaggacggggggagacucaggaaaguggaauugcgaucaagaagcuggacuggggcugagcgagccucagaggugaggcuggcuuaggguugggaaggcccuagguguuaccccagcacacuuuagaaaaaaggggguguugugaucuggaaggcaggagugagagaagggagcagaggguguggagauggaucagggcuccuccaggcaauugcagaucagacaggagccuccuaaacagcuaggugaggguuguucugaaagagcaggcuagggucagguuuaggggcggggugucugggaagaagaaaagggguggugagagcagcuaaggugggcccagcucugagggcccucagcugagaguggcuuaugggagaucaggcaggguucaucucccauggucucagcuucccuguggaagggagauggacaggggcugguggggcaggucacacugagaguagcccauuggaaucaacguaguugaaggacacuacuuucacuggggagaggccccuggaccaccuucagucucccuucgugugguauguguugggacuagugaauguccugaacccugagguucuuuuuagaagccacauggcuagggcuguuguuggugucaagagaccugucagcccaugcuuaggucggccacugacuuccucugucccuaccagaguaauucuggagccuguaagcaugguugaggugugggaagcugagagagccuacagaagagcaaggaggggccugguaaggugacccugugacccacagagccucacaaugacucauggucuaaguucaggagcaugcaccugcaggaucaucaguaugucuguggaaggggagccgagacccagugacuguggagugcaggauggggcaagagcucucuguuguggggguguuuugaaagcuggggaaggcccauauucucuagguuacagcugcccuggcugugaaggagcggggauaguacucccugauuccucucugucuccauagaaugcauccaccuuugaagaagugguccaggugccaucugccuaucagaagacuguccccauugaggccggugaguccuggcagucugaaagcacuguggcuaugugggguacaguguuggugccccguggugccccaggcaugacugaggggaaggccuuaccugugggguauuggugagaggugcuggagaccagguucugagagcagccuacguguaugcccugagccuacuucucucacccacagcuuugaccaguggcucagaaacauguccuuucaggugucuacuggguuugugaggagugagaaucaucuagagagugcauuuguauauaggauagaaauuucaaagcacaucaggagguggugaccauuggccacugaagacacaggaucaguucuuggguccauuaugaaagccaucagcaccuuuugcaaaggccucuggaggcaccacuuguuuuauugauaucuucugugucucacauuuacaaggguccagguauggugggauaugacaucaucucagcguuugggagacugaggcaggaggauugccacaaguucaagaucagccuggguuacguacugaggcuuggaccagcuucaacuauagagugagacccugucucagaaagaggaaagaaagaguaaacaggaugcuuuuaaagcagugagacugaggugcuugcacggaaaaugcaauuugcaauuagucugugucagguugcugagcaggguggcauugugaggaccacgggcuucuccuacaugcucagggcuuacuagggaacaggaaugacugugcuaggcagggcagaggaugcucucagggaagcuaugugagcucgaaggcccagugggcugugguuccaccgggcuggggauuccccugggcuguggucucugaacacuuccggaggcuugcucacccagcagccugcuaucuaucuguaccuugucugguuucaaauacuagauguagcugcucuuugauacuuuauggguucuuuuuuuccacccuuuauuauaccccuaucccaccccacgccauccccgcccccuaacaccuccccuccccuuucaccucagucacuagauaggagacaaaggaugaacgagggagagagaucuaagaacuuauuuccucuuguuucuucuuugagcaugaucacuagcaaacugcacccaccccccugaauggccaauacuaccuguuggcagucuuucaguuuuauacccucugaaaaauucccagaauuccacacaucacgcaaucacagagacuaucugcagcuggcaaaaccaugccucugcuaaagcacgaggcaaaucauagucagcuacuacagacagccccauauccccauaccugggauuaaaacaaaaacauuuuuguaauauuuuuguguuuuuuaaagaaaccaaaguuccaggacucucacuacagccagaucucuggauuaggccugcaacucaacuguagagcccuuuccuacaucuguaagcccuuuaaaugacaacugucauaaucauuguauuaguuugggaugucauugcggugaugaaacaccaugaccaguacaacucgggaaggaaaggguugauuuggcuuacgcuuucauaucacuguucaucacugaaggaaguugggacaggaacucaggcagggcaggaaccugcaggccaaagcugauucagaggccguggaggagugcugcauaguggccugcucagcacggcuugcucagccugcuugcuuucuuuucuuucuucuuuuuaaaguuuuauuuauuuuauguauaugaguacacuguugcucucuucagacacaccagaagagggcauuggaucccauuacagauggcugugagccaccaugugguugcugggaauugaauucaggaccucuggaagagcagucagugcucuuaaccacugagccaugucucuagucucugcuuucuuauagaacccaggaccacaagcccagguuugguucagcaugggcuaggccuuccuccaucuaucacuaauuaagaaaaugccccacaggcuuaccugaagcgugauuuuuuuuuuuuuuuauugcuuuugaggcaggguuuucuguauauccaugguuguccaggaacuuauuuuauagaccagagauuugccuaccucugccucccaaacacugggaauaaaggugugccccagcccugcccagcugaagccugagcuuauggagguauuguuuaguugagacccuggagggcucuaguaggcuuaagcaugacaaacauggcucugucaggucuugccuguucccugucccccuuccucucccuugcuaaaccauuaaaguacauuccuaaagcuagccaccaaggucuguucucuuuuuuuuguuuuuguuuuuuguuuuuguuuuuuguuuuuuugagacaggguuucucuguauagccuuggcuguccuggaacucacuuuguagaccaggcugaccuugaacucagaaauccgccugccucugccucccgagugcugggaucaaaggugugcgcccccaugcccggcaaggucuguucucuuauuuggccacauuguccuccuaaggcugaccaccaagguccagcuaucaaaaugcuauacugaucaaaccauccaaugaaaauaaaccaauccauccugaaagggguuucuuuguucccuuuauaaacugccauugccuacauacagguauaugggccuugucuaucuccugucuauccagagguaguccugugucccucagggcaaauguuccuuccccuucucccuuguuccuuuuccauuuccccucacccucugucuccugucugucucuuauccccugcccucugucccccuuuugcaaaucagucuccuuugugcugagagcucgguccugguguguccuaugccaacaguauugucagggucccuccucugcagugacucuaacuuacauaaaacucacauugacauaaaaguagucagcauacaugccaugguagcagccacaaaugucuaaacauccagauuuuaaauuuuuuuacuuuuauuuuuugcauuugucuuuguagacagggcuccacucuauaauccaggccucccugcucaggcaucccugagcucgcugauuagcucaggaaggccuugggcuuaaagucauucuccugccccccaucuugauucaagcacugagaucccagguguguguugugacagcuggcuaacccaggugucaugcaugaaaccuugacuuucauacugaccaacgacaguccuuucuucccuuauucauuguuuauuuguuucuguuuuucuguuuuguuuugagacagggucucauguagcccagucugccuggagcuccugguccuugugcuugagucucuucagugcuaggaugacagguuuucacuacugcacuuggcucagcaaugguuuuuuuccuuaccacauaggcccaccuuggagggaauacugccagacauucaaaccuacucccugucgugucugggaaaaugguguucugagaacagggcuguucacuugugggcuccugggacaggcgcaugcugcucgugccuuugugccugacauccucccugcucuugucuucuuauucauuuauuuauuuauuuuuguggugccugagauggcaccuggucccuuguaugucaggcaagggcuguaucacugagccacauugcagcuccuuccuggggaacuucugagccacaucaugguuagagggcuuagcuauuacuucauucagccugagugugugcugcucagccaugauagugucuagcuuaacuguggugcagacccagggcuucuaaggcccaucagucucccuugggcuuuguauguggccggccugggugagcugacugugcgccguggguauccuuacuccccacaagaggaugacuuugcugcaaggucacccugguguggcuuuuguccugguaggguguucugagacagauguguccucucuuuccucuaguaaccagcaaaaccaguaauauccgugcuaacuuugaaaaccuggcaaaggagagagagcaggaggacaggcggaaggcagaagccgagagagcucagcggauggccaaagaaagacaggagcaggaggaggcgcgcaggaagcuggaagugaguaacgcugccgugucuguccccaagccacugugggaggaagcuccuuucugucacuagucaccgcugugaguagagagagcagcugugggggcaggacuccguccuggggcuuguaugauaugcucucuugcucccgacuagauucaggaggggcugguaugguaggaaggcuugcuuacauggucacccacugucuggacaccuucaacacucauccuuuccccauggccacauguguauguuggccauggcucugcguggccauggcucugcagauuggucgggaagcagaacccucaguaacucagaguugcuuauaaacaugaggcuccaucuaagcugaugagcaccuccucccagggagauguugggguugagaccccacagaggaagauguggggucaguuuugaacugaugagacuagaccugacccccuugugcuucagguucuguguaacauuaaaccuacauuugacagugaaggcucuucuuggcacccagcuggguauagggagggcugggacaagccucacagccuauugucacaaaugggcuaacucaacagccaggccuccucauuguguuugaggcuuaaaccauccagaucugcuguacccucagaugcacaggagcaccagugccuggggugguucaucuuuggugauugccacggcuguuuuuguggcauaggacagacagcuuguuugcaaagacuguguuagagucuuuaugguguuucucucaagagcacacagugugacugcugcucccccuacacagaagagugagggugugaagugaauaggugagguucaguccuaucucuggggccugacuguagucgugaacauuuccugugucccaugcugcugccugagcuugcuccccuagugauuagaauaccccauacuugaugccacagcucugaagaccagggggccugagagguguugccccacugugguccuggaggcuuugggcagaucccauugcugccuucagcuucucuagcugccuuggcucuuuggcuuguggccaccucccucacacccuccgcuuuccucauuguucccuuaguucuaguucauuucccucuuguggggugacaugggcccacucacugccucuguuccugucuucuguuuaguguucuguugcaguccugggagccaggauuuugcccggggaugcuccauggguugggggugggggagucagaccaccugucagcccucaggggccaugucucccccacauguagaaaauaucuaucacuccaaggucccugaaacucugcacccauggcagcuuuggcucagagccccaaguugggagaugggcugagggccagguggaauggcugcuugaugucaccucugcccagugucucuguccacugcucaucuaagugcaucuucccacccugugacacaggaguaccacaggcuggaguccuugagacccaguagucaaugcuuuuuauucuuccagcaggcgccaagccucucucucacuuggguaguaccuccuuacaaagugguaggcuugacuuucaaguugucugacuaaucaugguuugcuguccugucuuaggagcaagccagagccaagaagcagacgcccccugcauccccuaguccucaaccaauugaagacagaccacccuccagccccaucuaugaggugaguagucacauggccaguugacugcccuagacucuuucagacuccugacacccuccucuucuguguuccuggagcauggugcucccuccacacccccagguuggcuguucucaccuuugggcagcccaaagcacuauggccuuccucucccuguggcuucugggaguucagucggugcugcaugcucaguauuuugguuuuccugaccgugcucccucuggaaugaacucucccuaaggagaguggcagagguggcccuaagacaguguucuuuccuagucccuugagcaucuuguccucugguccuaguggccuccucacaugaagcucuguggaguccuugcuuccuuccugccucaagucucccauacucugccuggacucagggcucccucacugaaguaaagccccugugcccacagccaaaucccacggaucccagccaguccucauguucugcccuuccauuagcuagauaacauugcucgugucuucuaguguggacagggaccacgaccuguucaccacuaggauuccuugucuuugaacaccuuuguuacuuucucugcauggcagucagccuuccccugugagacuucucaguggauguggccuuguagcaaguggcccaaccaacagaggcaugucuacauagucacaccuccuucugggccaaguguuggaacacuggcucuuuguugaggcuggggacagggacagguccugugucuggcagaucagcugggaccaggagccaagggaaguaccuaaaguaccuaagugggaagauggggcaggguccagugcugagccaccacaacaggaacugacagcauuacagcaggcucugccugccaccaucuugcaacaugggacugcuccuggcccugagugaucuccuugggcuguggcagcuugcucugccuggcugcccuccacaggaagcuucugcccccacucccugugcaugaagcuuccauuuuugccuuguuuugucugaccaugaaggucacuugugaauggggcucuucugucuguggugauaguguaagagaugccugugucccucccuaggaugcagcuccguucaaggccgagccgagcuaccgagguagcgaaccugagccugaguacagcaucgaggccgcaggcauuccugaggcuggcagccagcaaggccugaccuauacaucagagcccguguacgagacuacagaggcuccuggccacuaucaagcagguacuggaccccacucuagccauacccagggaagggaggguuccugagaagcgccccgcccccagucugcuccucagagagcacagguuggccugcuaucugaucgcccuggaaugugcauucugugucacccccuggaucggagaaagucagguuuucuacugaugugaugaaacacaaugaccaaagcaguuggggaaaaaaggguuuauucagcuuacaaguccacaucacuguccauuacugaagggagucaggaacuccaacagggcaggaaucuggaggcaggaacugaugcagaggcuauggaggggaggagugcugcuuacuggcuugcucagccugcuugcuuauggaacucagcaucacuagcccaggaaugguaccacccacauggguugagcccuccccaucaaucacuaaauaagaaaaugucuuauaagugauaccccucucccccuuuuguggagauaggauuucucuauauagcucugacuguccuagaacucacucuguagguguggcuggccuugaacucagagauccgccuaccucugacucccaauaaaggcaugcaccaccagcacccagcuaagucuuuuuguuucuaggagguaucuggucccuccaucccaauaccugccacauaggaacccagcugaugugaagagcaaguuucccaucaguccuugggcaguguguuugcggggccuggccaucacucagcaguucugcuuuuuuacagaggaugacaccuacgauggguaugagagugaccugggcaucacagccaucgcccuguaugacuaccaggcugguaaggcacugacaguggccugcgggcacacauguuccuaccuacccagggugaaguucccagccacaccccuccugagaccaguucugggaaggaauucaggacuguugugugcuuaguuuugaaccagggccuguuacccagucugaccuugaacucccaggauuacacaaucgugucucaguuuuuccagugcuugacaccuuagguggauuuuauuuugucuggguacaguuucuacaguguaucuugaaguuacagguguuaccugggaugaugucagagaugccccugucuaugccucccucucaucugaauccuuggggaucuaaaggugcagagcucccuuagucacagacccacugugcaggcagggaacaugguucuacaggaacauaccccacucuccagugaagaugccacacacaggaggacuuagaaccaguguggccccucucugucacgucagcacuuccauuccucccuuauuacuugagcacugucuuauaggaugcauggcugggacucccucgaguucucaggccccaggcucagauagagagguccgcaagucccuucuuuuccuaaacagagaccuggcauguauuuccuguacacacaggggugcugugacuuuuaggccaucaucucacgaugcucuagagucuagauuuucauguauaaccuuagcagcucuccagcagcccucuccauugcccuucuugucauguaucuaacagugaaggcccucuccccugccgggugggugucuuagucucagucuugaugucuucccccuggucaggugauaaucccaucugagucucuuucugcucuccuucccuagcuggcgaugaugagaucuccuuugacccugaugacaucaucaccaacauagaaaugauugacgauggcugguggcguggggugugcaagggcagauacgggcucuucccagccaacuauguggagcugcggcaguagggcugccacccagagccuaccggcaccagcacaggguucacacuacagagcaucugcguguguuugaguugguuucugcuuccguuucuguuuuuguucuuuuucugaagguggggaggggaauauucauauugacuuuauauuuaauacaucugcugaugcuucggggcauguccugccacaggauuugcuaaugucugaugaucauguucacagagaacaugggugauuacuugcagccaucccagguguuuuaguuuugccaagcugacugugguauguagccacuucagggguugcgcuucucacuagguuggcgguacauguggccuugugcccacccccauccccauuguagucagguucccaggauggagacagugcuccugggguggccacucagugaggaggcucucugggguccaguguuuggaagaggaggaaaggggaccaaagggaagugagguccuagagcguugacacugagggaaguccuaucugucaguccugaccacuuaagccaggaccccaugcuuccuuuacucugucuccucaucucuguaccuccccugacaccccaguccugguuggcccuuucuccugccuugcccugaagucuuaccuucucccauugcauucaaggccuauagcacaaagugcaucucagagaugugcuaguggcuuauccugggcuuggccugcaacaugggaggcuugggacgggggucuuggaccugcucaugaccccugagcagccugcaaugaggugugugugcccagccacuuggcugggcagggagauagauagcuucuuccugcaagcuuccagaagcacgcuguguucuuuuugccaaauauguucaguuauagucagcugauagauugauguggcugaaaacaggaccgagugaacugaugcucccaccugggugccuccauggcuuccuugagcaacugucccuaagaugcuuucaaguguaugagacaugaggaggcugggccacucugguuaugcacagucaggcaaacuguccuuguagacgaguccccgacucugggauacaugaggaucaaugcccguuuucuccccgugugcuuuccugcagaauccuugccuuuccguuguuagguuggguuuucuauaugaauuaucaucuggaauucuguagcacaccucauagguauggaauuuuuuuaaauuaaauauucagaauaaacuuuuuugauccauuuacuguguga

SEQ ID NO: 12136 - RNA, 4115 nt, Mus musculus
gauuuccuaugugggaucgcugaggggcagcccggcguaccacugccauggacccauuccuggugcugcugcacucgcuguccggcagccugucgggcaacgaucugauggagcucaaguucuugugccgcgagcgcgugagcaaacgaaagcuggagcgcgugcagaguggccuggaccuguucacggugcugcuggagcagaacgaccuggagcgcgggcacaccgggcugcugcgcgaguugcuggccucgcugcgccgacacgaucuacugcagcgccuggacgacuucgaggcggggacggcgaccgcugcgcccccgggggaggcaggugggcagggggcggggaaugggcggggaggccuggccucagugcacccuccacuggcuccgacugggauggacucuagggcacgcccacuuuuuucaaccgcuugagccggaagcugggaggucuuguuucuuacuggcagugccaagguugaacccaaggguucgugccacuugcccaaccccaguauuaacucgccucagaccugcagugcuucguuggaaaacucagcuaagaagugaaugugacuaaggcaucuuaaccccagugaggguagcguugaagagugggcagaggucacgugugccggcugcucggcaccauuuccguagugggagugccuguguccaagacugcccuuccuggccaaggaaagauugcgcggcggcugugcucucugguccagagugcagugucugguuaucggcaguuacuucuguuuugcguagagaggaggcgcuaugccuccccauaacgcacaguggauagcagccacagcugagcaacaccaggcuggccuugggauguagauacagauuaagcauauauuagacacuugaucacuugugacaaauacucgagaagccauuuaaaggggcaaagguuuauuuaguuccugguugguugucaccguugcucuuugucuacagugacacagaacaucaaagcagcuggagggccuguggaguaaagcuucccacugccggugugugcaagauccacacgaaaauggauuguguauucacaucuccaaggcauuccaauguuuguuauuguuacaggaauccaguaaagggucuucagccacugcccagggcucccuacagagauuacaccuugccugugucuaagcaggggcuccagaguagcacagagacagaucuuuuguggugucuggucaaaccagcaaaggucacaguguaagauguagcuuuggggacuuuggccaacccacuauugagcgggguguuagggcagcccugcuuuuucccucugacacuccaguccucaguugacagucuucuaagccauagcucgcuguggcccaggcugagaauguggcugggcagaucaggccacuuuggguaucuugaaguagcuccugugcuacuuagugucagcacaggaccugaguggcuuugaagugauguugucuucgaagugcucaggcccaugcuugguggccgguagggagacuugccccagcuccucagucaagucacacugcucuuuucccuccuagaucugcagguggcauuugacauugugugugacaauguggggagagacuggaaaagacuggcccgcgagcugaaggugucugaggccaagauggaugggauugaggagaaguacccccgaagucugagugagcggguaagggagagucugaaagucuggaagaaugcugagaagaagaacgccucgguggccggacugguuaaggcgcugcggaccugcaggcugaaucugguggcugaccugguggaagaagcccaggaaucugugagcaagagugagaauauguccccaguacuaagggauucaacugugucuuccucagaaacacccugacaagccuacagcuccucucaggagucacuguggacuugaucacaccaugauguagcaccaagugccuuuugugcccagugccaaaaagaccuugcugauccagggcggguccccucccaccagcuccuggaguauaucuguaucuacggaaccucugcucccugggcuuucggaacacaugaagguuccccgucguguucuccaccacugcuccucccccccacccccccaagaggucucuggucuugcaagaaggaaguugaagcugauggcacaugugcugacugcaguuugagagccuucuucuuguuccuugggggaagacaccaucucaguuaagaucacuugguugccuuacaguuggccaagaggacaucugucucacauccuuggaggccaucagacagcagcuccugaccccccacccucaaacaagugcaagaccccugugaggacugugguuuaaaggguagcaccuugccuccaugguggucuguaagcaagugcccugggccuaccuacauauaguggcucacucugaaauccuagcacuugagaguugagaacugcacuuuacagcagccugagcuacaaaugagauguucuccccaaacacacaaaagcaagugccuuuaccuggagauaacuugugucaccaagaauuucuauuauauuaagaacccuucuaaccucagaaaucccucccaucaggcugacugaggugugcuuacagcccugggugcuaguugugaauggagugaugugauuuccuucacaccagcaggggcccugacugccacacuuggagcccaauaaaccauugucucagcuuucuaaccuuuggcugggugugauaauacauaccuuugauccuagcuuuuuagggagguggaagcagguggaucucugugaucuaugaguucaaggacagccuagccuacauagagaacacuaaguagaaagaccauaucucaaauaaauaaaaguucaugucuggagaagaggaucuuagccacagguucuccugacagagugaagagcuguaccucacuguccuaaccuaauguggacuucaagugaccagccuggggccuguacucaaacacagaucagucauuuccuggcacuuagguucuaugcccucauuuccugcucccugcuccaccuauccaccagacagcugaccccucagcacacuugaacucuccucaaucgccuuccgcauuguuggucccuccugcauuccuuggguugcacccuccuccacagccucaagccuaccauguucuucagcucagcauugcuccaucuggcuguuuguucaaauucuuggccauugaggccuccugacuacucuggggacucauccuguuuucucugaccccauuucucaccuggcuguagccacaaugcucuugacuccccagacuaugcauaggccuguauaaggugucugguggguguucucugucauucucuaccccucccccuuucuccaguuugaaggguuuaagacacgguuucuuguagcccagauguaaccuagguuggccucaagcugaguguaacugaagugaccuugaacuccuuucugaucauccuaugcgcuaggaagccugggcaacccuacugcucuugcugaugccuuuuaacuguccuguggcaagucacaggucgaugggcuuagaugucacuuuuuuuuuuuuuuuuuuuuuugguuuuuccagacaggguuucucuguauagcccuggcuguccuggaacucacuuuguagaccaggcuggccuugaacucagaaauccgccugccucugccuccccagugcugggaucaaaggcgugcgucaccacgcccggcgugucacauuuuuuguacagcucaggaauccaaaauggcucuccagaguucagcucagauaugagcaagcugguuuccuucuagauuuaagagaaugucacuugcuguauuccccucuuuaaguggcaguauugaguuacuacuguugcagggcuuuugggccaccaaagaaacuuaucccuuuguacagagucccuucaaccacguuggggauuaaaacgcggucaucaucagggugagcaccccacacaucucugcaucuccccaacuugugcccaguuuugcccugaacaccucagcaucaauuccuccugcugcuaauaaaggcuugucagagcugcacagcuca

SEQ ID NO: 12137 - RNA, 4738 nt, Mus musculus
uguuaaauagcaagacagaaagacaccuuuaaugugugaaucacagcccccuccacgguccacugccucagguugccaggacugacugccauuggcugggcuccauccgggauuaggaugaccccuguaauaagaauucccucucauguaacuccacauacaucuugaacuucgagucuuccagagucucugacucaagccccuuagcagcuggcacuugcucuuugaaagcuguaaaaggcaugcaaguucuuggucccccaagcagccagcccaaagacaaggguggggaggccagggcuccaagugaaucuugggugcccacuggaguuggucucagagggcuuuccagguggccacucaggccacagccaguccaccuguaugcagcugggugcuuggaguggcccugguagacaaagucuccaucuugccaugaucacuugggcucugcuucuucugccuccgcugccugggcuggcugcccucuccuggggcucguggcuggcuacucugcagcagccgcaccaucucaugguccuuguggcccagcacucggggcaggaagagagaggacuuuugugugcggcgggucuugaagccccugcguggccgacccuugccauucaccgacacguaccaaggucucugggcaccagguugccguugagcuccuggcccacuggacccugugcgguacaggcgggaagcauauguauuguagcccagcucauggauccguuccacaaacucacacucugcguuguagugauccugugagacagaagccacagucaacagccuuggagccaugaugucaauggggcuacaucuccccaaugccucccuuucuccuaaggcugccuggaccagcaguccacaccugccacugucuaggcagcuuggcuauccaaccuguccaagucugugcccugcuccaagugacuuccuuccacuauccccuuuugcugcagccuugcacuuggcucagugcuugguaugugguagacagagcaugcuggagguggcuggcuagcuggugugucagaggguggaugaauggauguguuggugaguggcugaacaggcagguggauguaauagguggauggguagcuagguauguugcugggugggugagugacuguguagguggauagacaaauaaauguaucagugguuagauaauuggguguaaggaugguacauggguggauagauggauggaugauagguugggacguaugaacgaguguauagauggagguguggguagaugacugaguguguagguggguggauagauggcaggcugaguagauggguggauagauggauggauggaugauagacaaugaauggacagacugucaugaaggaugagcugacuucauucagccugcuuuuacaguagagggagcugugggcaguuguggucgaagacuuccaggagguggggauugacuauggaaugucacugucccauggauauagcacauaggcagccacauuacgcacccaggacacccagggacaggucuacaggaagaggccuuagacaccagccagcagcugaaagaagcugggaccugucugcaagucuguaggaccaucccugauggguuaucuggaaaguucuacuccaaccagugggaccccugaccucaucaucccugcuccccugaagccaagagagcacaggcaugccccccaucauguucuucccugugggcagaucugucauugaguguacccaaaaccucacccuaaggcagaguuucugggggauagucagguucauuguaaagucagcugaguucacucacuagagugggucaggacacagagucuaagagucagggaaaucaccagcccagcucugcagcagcuaagacccaucacucaggcaagaguguguuucugucacaccucaggucaggagaauggagaccccugagcuccuccuguugcccauccaggagcguggaggccaauucagcuagguuagcuggggaaccccaaaagccauccugccuccucccccugcccugggaugaccacacuuuauccuggcuuugauacaugggugcuggagacccucagguucucaugcugugcaaccaguacuagacugacagccauuucuccagucuccugcuaagccagacaacuguugccuucccacccugagaagaacaggccaagcaccagccuuccuccuuccacagaugcagggcagguuugccaugaccugcucucccucaacugcagcuaugguggcuacucacaccauggagguuugggacccugcugccaugcucacuuccugucuccaucauuucgacguuuagagaaagagacugacuucagacagguggaaagggcauuuuccugagcaccuaaagucuguguugggcaggcacucagaagcccaggagggaucuggacgagcuugagucuggcaugaccugggggcuaagaagucuaucucucauguccucuucugucccccaaucagaugcucaagccagaugguuauuccaucagcaccugcccaccaguaauggaacucaccgaagcauacagccguccucucuuguucauggccagguaccgcccagaaaagagcccuuugauggccaccacgcccacuuccaccgcaguaaucuccaggaugccuggaaagagucaggaagaguccaucaacgucucaaccuaagcagaaccucagccugagccagcuucccccucuaggcucaggaagcugggacaggucugguuggaaguccugguaggaagaaaacauugagcaggugguaaggaaaggggcauccugccacugugcgggagaccuuaauccuaaccucaggagaagacaugaugggaauguucugccccugccaugcaccuugggugcaaccuggacagaucgacccagucuguauuuugugcaaucuugugaaugccucggucucgcaagcaucaaguaacuuaagccacacauaaugguuugggagauccaaaccccagagcagauggagacccagaaggggagguggccaagacucuuagggaagccaggguuugcagcccagccccccacuggcagcaagugauccaaagaugugugcugagagguagccugccacagaaaagggccugggugcugaggaaaggugacagggcucacccaggccuaagaguagguacaaaaguuaacaaucucucagcgcagaugacagagaaguugcagagacugaucaccagaguuugaucgaggaacccacaugauggaaguagagaccagacuccagcuaguggcucaaugaccuccacacacucacuguggcacacaaaacaaacaaaauacaaaaacaaccaaacuucuaccagccuuugccgugaacaguauagugcuuuugggaggggagcggaggucaaagacccccgggauagugggucgaggauucacucccuuucuagggagcggccgcugggacccagcaugguccagauuaccggacucaguugagauucugcccuagccacgguuuggaggggugcaggaugaggccucuacagcuggcgccagacgagcaccagacugagugccccuagguggcagcgaaugugccccuccucuacaucugggaccucccgggauccagcaaauggggaguggugcgcaugaggagccccgcgcuccaggcccgacagggucuaguccccaggacgcccccgcggggcugcggcuuugcaggaggaagcugcgguucccccccgccgcccgcgccccccguucggcuuccugcgccccgggcgcggugaguuuugcgcggccucccucccacgcagcgagcaacgcuccugguccagcuccgcucguggguacccaacugaagaagccaaacccugcaauacucgggaacuggcccuggguaugaucgagcugcgggcugugggugcgugucagcagcauccggaacacgaggggacgccuguuuguccugucgcgcucucuugcagggcgcaggacgcgggacaagccugucgucagaugccgcguugcggaaaccgagcucugccuaguggaguguccuccgcgcaucggcugagagcaaagagaacgaaagggacuggccaugcaccccggggucgucaaaacaauaaagagggcgauaaauccuuguccaacggcuuuucauugaguaauagaaacgugucagaaccggggucgccucccgcgcagcuccugggggagcgggacgggcggggcagcuugcugaguucgguagcugggaccgcggcggcgucuucggacugaccucagcucugccucuaucuaggacguggcggcaggggaccgagcccuccggucucuuccgccacccuccccucccuguccggaccugaacacucacuauaggcgcuguucucaaggcugccguucacgcggccgcuugggugcagcuggaggugguacuugguagcgcaguagagcuugcggcgccguggcgccccgccgaggugcucguaaacgccaccacggccgcccgcaucgcgucguagucgcgucccgggccccguaguuggccagcuggguuccagcaagcugagcagcagaagccagaucaggcccaucccggcaucgcgcccgcccgcagcggcugcugcgccagcgcgggucucacgaaggcgcggcgcugggagcacacgcccgcgcgccaggccggcucga

SEQ ID NO: 12138 - RNA, 24524 nt, Mus musculus
gccaagacagaccuccugccauuaggcacaacacccggaucuagucuguuuggguguuuugcagcuggcuauauccacagucugaucugacuccucagcccucugccgcaugaucauagguaccaccaggucaaacaagguuucaaagaggagguccacauuguauccagucuuggcacuggucucgaagcacaucugcucagcagcuggcaucucccucucauccagcaucuuguacuucaggaucuucuuguaaagggccacugcauccucuggcugcaccugcuuggguaccuugguggagacacagcugcccaccuugccagaggccgguccuuccuucuccccgcccucggugucccgcuccgaggucagguccacuuuguuccccacaauggcaaacaggcagucauuguuggcuguuucugucaggcccaggaaucuguccuccagcucaaacaggcucugugggugguucacaucguauguaaggaugauagcggccgcuccgcggcaguacagggagcccagaccaugaaacugcucccgcccugccagaaagaaagagagaaagaggauuauuuaucucaggauacgcccaccaccaaacuguggucagggucuccacucugcccccagaggauuuaggaccccagggcagggacaccaacgcucauauaaagcuggcccaggugacugagcagggccccauagccaguuaaagccggccucuccacaacaggcacuagaagcuguucucauaccaccauugucaguguucaggacaagagacacacaggugucuccugaucagagagugggguuguguuuucucauuuuaaaauaagaugcugucgggacuugacuucaaauccccacaccucuguaaaaagauagaggaaagaugucugagauuuccaggccagcagggguuacauaccgagacucugccgcaaaaaaaaaaaaaaaaaaaaaaagucauggccacagguaaacccguaaaccuaucccugauguggggagaagacacgagaauugccgggacuugcuagccacucuccuagcuccagguucagugaaaggccccaucucgagggccuaagaugagcaguaauagaguacaacacuggaugucuuauucugcuggccccugugcaagcauggaccuacacauacucacaugcucaccucucucucucucucucucucucucucucacacacacacacacacacacacacacacacacacacacacacggaaaaaaaacuaugcuuaaagcacaggauucccaggcucugagagacaccucagaggccaaaagcacuggcugcucuuccagaggaccuagguucaauuuacagcacccuugugauggcuccuaaucauguauacuccagcuccaggagaucugaugcccucuuuuguucccuacagacaccaggcauacaagugguacacagacauaugugcaggcaaaacacuuauacacauaaaauuaaaaauuuaaagcaaugcugcccacaugggucuugacuugggcugcacguguguauguaugauacugggaauggauccagggccuuguagaugugagguaagcaagcacccgacacugagcugagucccacagugggucucuaauagcaacagucugucacacucugcgaugucccagucagagcagacucugaggaaaugagaugguucauacucauugagugaggaucccagucauccauggcucaagaguguucucacaucugcaguuauuugugcugugacauggggacaugcucgggaagcagcgaugccaggacacgaugcuguacucccacugccaugaggaggagcgcaaggagcugcagcagugcuccuaaggagccuuuagcaucccaccagcccugcaaacagcacaauguaaccacuucaaagccacaauagcuauuccaccugugguuggaucucauuaccgugggguucaugcugucuacuaggcagaaucuagagucaccaggagcaggccugugcuuuaacuuaggugggaugaccauccacuguggacggcucccucccuggcugacacuguacuauaauggagggaaaaggggggaggggggagugacagcauggcuucaccacucucuguuacuguggaugucaugugaccaacuacuuccugcuacuucaugacugcccacugugauggacugcacccuugaacugaaagcugaaauaaaccccuucuccuuacauugccuuugucggggaaaagaacaacauuaccauguugauaguaaaauauauaccaguaaaaacacauaccaacuguagguggcucguuguuguugguuuguuuguuuuuuagacagggucucaccauguuucuaucacugggcuagccuggaacuugcuauguagaccaggcugccuuugaacccacagagacucaggugccucugccuuccaauccuacuuugccaaggucaauaauaaucuuuaaauaccuccacgccugccuuugucaguagcuaacgcccucuaaucuauuaucugaguaauagaucauacugagauguuugugaugguugguauaugcuuggcccaaggaguggcacuauuagaagguguggccuuauuagaauagauguagccuuguuagaguaggugugucacugugggcgugggcuuaagacccucauccuagcugccuggaagucagucuuccacuagcagccuucagaugaagauguagaacucucagcuccuccugcaccacaccugccuggaugcugccaugcucccgccuugacgauaauggacugaaccucugaaccuguaagccagccccaguuaaauguuguccuuuauaagcacugccuuggucauggugucuguucacagcaguaaaacccuaacuaagacaauguugaagacuguuacaccuuauuugagucaagggguccauggaauacaaaaugauggugucucuggcugcuuuccaccccgcuuuccacuacaauuuucagccagguggcaacaaaccccaucccauuuucaaccauucugaaauggcuguauuuugacaggguacuuaugcccagccaaacagugcuagccuccaaauguauggcuacugccccacuauagucugcaacacugacaagacagacuuuugcuuacaaaagagaaauacucccccccaacacacacaaacaugcaugcacacacacacaugcauacauacacauaaauguccacauacacaugcauguauauauacaauacacccaaacacacacacacacacacacacacacacacacacacacacacacauacacacacacacacaccaggcaugucucagcacaacuuuucagguucauaaaauuucaaacagcuagaauguuauccauuugaccacagauuccacaugagaacagccacaaggacacagagagaacauuccaucagccgugaaagaauuuuuuucaagucucuguaacauaguucacuaaggacaaagaaagaauuguauuaccacccaugccucaaauagcuucugucccagauaaaucugccugaucggaggccugcaguggcagaacaaaccugcaauccagcacuuggagaacuggaauaggugguuugacaguaguaggcuaaccugggcuacacagcgagacccuggucugaaaaaaaguaggauuugccuuugguaaguaaauaguaguuauauaaaaugaagacugcaaacacugaaggaaguaggagacauaagacagagaacuccgaaggcagcagaggaagggcugcucaaccaggcucgucauauuaugaccggccguuaaugacaacagcaaaucagauaaagagcuuccaggcuagucuucaugcucagaucucuagcucuccugguggcuaacaggacucccagguggcaccaaugugggcagcgcccauugcaagauggucccagauaaaaggaacaggcaccaugcaggagacccaggcacugagacagggcagagaaacugguuggcaaggugucuuucuaccuuauuggguuuuccaaacucgcuuugccuucauauguaacauuccucaucugugcccucaucugugaacuugugcccagucaggcaggcuugagcaggucccgaggcccucccccgacaccccucccccugguaggacaagagcaugucauuucccccccccuccccccccccgcccugucuccuucccacuagguuccugggucccuagccaagcagcuuggcuuccuugagaacuaacauuugacgacuucccggggauuccaaaauugacacagaaagucccugugagccaggcaagccucucaauguaaguuucccuacugcugaaaugcgguagcaucuguuaggaaugguugagaaaacagaaugaguuuguccugguaaacagcuuagcacuguaccuagcaugugaucacuacaucgaguuugacuccucccccucaccccucugugugugaguuccacacacagucagggucuacuaucucacauacacaucugcacacugucucugcggcuggcuggucaccggggcagcugacccaugcucugugucucccuaguucuugaaaaggacuuucuccccagugcuggugcuucucugauucaggguuuaaaaaggguuaaaaaggcccaagggcaaaccuagggaaaugcccuacaauaacccgggucagcucccagggcucuguaaacagcccagccacucucugccacacuccccaguccccacagccaguuuuugaguccaaauauugugaauuuuacuuccguguuccauaucacugaauggguugguuuguccuucagaaaucacagauaacccuaccugcauacucucaaugaguggggcacagggggguggcacuuucaaaaaugcccgacacucugacccuagauccacauggaucaggagauagauacaaugugcggcacuugucuggguuccauuacccaaaaccagagaaaauaaacacauuuuuuuuuuaaguagcugcugaaacgugagacucagaucacuucuauaagcuccgggccagcccagagaaagggggaguuuugucaagcaagcucugccacaagcauccccauagccuauuagcuggaagcuggcagagucccuguaaugguguaaacaaggagaagccaaagagucauguaagcagagaugggagcaaggacaaaggucagagccaugagcucagccuuggaggcccgcauggcucagccuggguugagcccugaugugccuuccuguauacuuuguuugcaugaaauuacgauuaccccaguguuuucaagcucaacccgcaggggcuaccagaaagguuacugaguuccacuucaugaaguccagugaauuuuaaacaucuacagccagccaucaacuuccuuuaguacacaagagcuagaacauucuuaaaguaucugaugcugggaugcccgguggaagucacggcucuccaggaauguuugcaaagccaaauaauuaaaucuucaugcagcaaggaaaaaugggccacauggcucccugggucagugguucucaaccugugggucucaacaucuuuaagauugaacggcccuuucacaggggucgucaagaccaucagaagacgcagguguuuacguuaugauucacaacuguagcaaaauuacaguuaugaaguagcaacacaaauaauuuuacggucgggggucaccacaacauaaggaacuguauuaaagggucgcaggaauaggaaaguugagcaaccacuggauucaugagaugggcugcccgaggacccacuguccccaccucagguaguaaauacagaguguggaguaguaagccacaggaccuuagugcccaccaacaggcuuuaucugagacucuuucaugcaccagggcuucucucagggaacaauauggaagaugugauagugcacgccuuacucucagcacacaggaggauucgcaagcccuucaguauguggguagaucccugugagcucaaggccagccuggucuauauagugagcucaggacagccaggacuuuguaaaaaagauccugucccuaaaaacaaccaaacaaauaguacuaccaaugauaucauggcacaaccuaccucagacagaccacaagccagagucugguccaacgaugucuagcuguuccugacagugucacagaugagcugggaccuucuguaacuuaguacucagguucaggaauccccuaggaaguucccagcacccaggcagaaauccaggcauccuccuuagaucucaaccugagcuauucccugagggaaggcccuaauacuacaagagugauguuuuggcuucauaagaccuguugcucaggaaaaaaagguguuuaacugugagguuccccaugaaguauaaguggucucagcauccugacuuucugguacaucaucucuaggucaaccaucaagguucauucccaacacacacacauaggcacagugucagagagcuguaguuuccagggugacuagacccgcauacaccugaucugacuccccacaaugcugugcacuuucaaacaccagaaguagugcucugcccugugaugguuugaaugagaauggcccccauaguguuauauauuuaaaugccuagucaccagggaguggagcuguuugaaaggauuagaaggauuaaaagaccauguagcuguggccuacuuggaggaagcaugcugguccagggaggugagcuuugauguuucaaaagcccccaucagguccggugugucucucuuuuucucccuguggccaggauguaauaucuccacacucugcauguacugccugagguagggcagcccaucugacauuaccacuccaacaacaugcaugccugcgugcaccaugcccucacuaccauaaugauaauagacuagaccucugaagcuauaagcaagccccaguucaaugcuuccuuucauaguuuccuuggucauugugucccuucacagcaauaccccuccacugaccacuuccccauuggcagucucuuccugaccugcugaccuagcugguaguuucuacuggaaauccccugcagcacacacagaccccccucagcuuucaaaguaugaggagccaccggccuggcagcuguccaacaccaguuccgccuucagaguucacuaagagggcccagaggagaaggcagggcucacagaaucagcagccagccucaagucugggacuacacuucacagauaaaggggucugggguaauggaaauagaacaagaaaucuaaaauccaagcuauuuuuucugccuuuuucaguggcuuccuccuccuuucuuauccuuuaagcauaugucccaagaaagggaauuuucuauaucauaaauccaaagacauguccccacccucaucccuagaacccauguauagaaucuaauugggaaauaaagcuagggucuaaaaaguuuucugaauuaucccaacagcccuaaauccuauuacaagugcccacagaagacacacacagaagagaagaccccaugacccuggagacaaagacuggagugacucagccgcuggucuacaccagcaguucucaaccuguugguuacaauucuuuuggaagccaaauggcccuuucacaggggucaucuaagaccauuggaaaaaacacagagauuucauuuacauuaugauucacagcaguaguaacaugaaauagcaacgaagaugauuuuaugguuguaggacaccgcaacacgagaaacuguuaaaggguccuggcguuaggaagguuggucacuaauucagucccccagccucugcagcuugauuccacucaucuguggucucugucacaguugucuccagagcccaaugcucuccaagucaccaacagcaggaaucucagcuuuuucugcccugcugucaucugggagguagcuuucagcuggggcugggugccagaucacugaugucaggcagacacaggcagguccuugguggccuugucucagcacugccugcaggacagucaccaggaaaccaucaaaaccagaccuccaggccaucugcacaggaaccagaucagcagguucccgggcugggaggcagcccugguuccaggccucaauccaucacuuucuacccagagggccuuuccagguaagcagcucacucucagcacgaggccugugagucccaaaggccauguggauaugacacagccaaaucacucaacaacccccccccaugacccccugugucacuccgugaacccccacuccaaggccaauggcugcaucucucaccuggcauccaauacccacuccccauugcuccuuuccagccuagccucaaacuucccccacuaucccuuuguagccuaacccucccuccacuccuccccaccccugucccauugcccuuuacagccuaacccuccacuuccccagcaggaccuaaugcucuccaccgucucuccguccccuccaucuccaggcuccucugaccauuucagccuccauaauuaacacuugcucauuccuuccugcacgcugugguuaaacaugggaagcaaugaaugguuuuuaaaugguuccuauuauuuuuaaucacuggauggccagcaccauccaacaacaacaacaaagcuaccccaaccccauacaauaguugcugacugccacacuuaaguuuaaaaggguagagcuggggaugauggcucagccagcaaagugcuuacuguacaaacaugaggccugagucccaucccagagcucagguauaaagccagggugugcuggcgaagacaggaggauguuggcagcagccuagccaacucagcaagucccaagucagugaagagucccugucucaaaaacaaggugaacgacaucuuggggaauggcaagaugucguugaccucuggcaucuauauacauaugcagugcacauacaugcaugugcacacauacgaacacacacaaaacacauuuuuugacacaggguuucucuguguagcccuggcuguccuggaacucacucuguagaccagacuggccuugaacucagaaaucugccugcuucugccucccaagggcugggauuaaaggcuugugccaccacugcccagcugacccacauaauuuuuuaucuuuacuucaauauacaguccacagaaagcuauugugccaccacuucuaaaccagaguguauuuuacuccgugugacaccaccacuguucaguucacacgugaccauggcuguguuuaggcagagaagauggacuuaaauucucugaggcagaggccaaaugcaccugugugcccaguucccagaaccagggugugcuccagccucacaggaaggaggcuaggaaggagaaaauggcaccagcaucuucaguccucccaacccucagucaggugccaaucaagccuguaucuuuuccccuuuccucaucacaagccaggccacagaugccagcaaucccaguccccuggaaucugucuugccugucccagccucacaguccuucuuuccacuugucaugggcaacuaagacucuacggauagccaggaaacccugccccaugcccuguucucagccccagauggcaaguggcaccuaagacaguacaccuucucagaagccuuacacagaauccuggcuuucacuuccaccuugaaaggugagcagaaggucaaaccaccaccacucauguccaaaaauagauaaauuuacacuacggucacuaauguagcuucaacuaugcuccuaaaagauaacucaaguucucauuuccacccugugucugugaccuucucugggggagaugauuagcuaagcucaccacaucacacuggacagugcccagugcucagcaggcugugagucauggcucugcaagaagaggagggucagacacauagaggaauagugaggccucggggacaggaccgugaagaucccccagaggagggagacauuugguuuuugcucuguggugaagccagccaccagcaccuggacuucagacauccaacuccagaauuucaagagaaucaguuucuauugugguaagccacagacagugugaaacucccuaaagcagcccugggcuacucgggccuagacuggaggccgccaccuuucacccucaucaggaagucagaaaccaugaacccaucgacaaucauacuuccuuuuccuccgugcacaggggugagacgggcaagggguguuccuuccauccaggccagccaucccuugucccaccuucaaaaccaagacaagccaaucacaaacuucagugaaggaagagaaauugguaagaauggaacacaugacacuggacuugcgucacaaaaacccgaaugcuacuccugaaccagcucagcaaagccacucacuuccugagcacaggacuuaaccaaguacagagauucccagagacaucagcaugugacuuuguuucucaaccuuaaaccggauccaaacuagaaagaacgaccuuugcccucccuucugacuucuugagaaauaaagagccaagccugguuucuuuaucacuccggacaaacacaaggaugaagagguguaacccugaacagcugugcaagagacuaaggaccuacaggucaaaacuagccuccagcugcaugguagggacagaagcugcccugaggccugugaggaugcagcuggcccguacugaacugaacaguaagcgccaagguggccaccauaggaccuagggcauuaaagccagugaaacagagcugggcuaugaucacaggagccauggccacauaggcaguagggaagguuacagucagaguucaggucccugauccucauaccauguacacugucaaccucggguccuaaucugaaauguugaggaaacagaugucaggaaaagaaggcugguggccucagaaguggcucugucagugaagugcuugcucacaagcaguaagaccugaguuuggaugaccuaaaacccagaugauaaagcgauguauggcaaugugcuccugugacccuggcacugagaacaaagauaggcugaucccuggggccagucugucuagcuaaacuuaugagccucagguucagugagagacccugccucaaagucuaaagaaggugauagcuggggaagacaccccacgucauccucacacaaccauacagcacaugcaagagagagagagagagagugugugugugugugugugugugugugugugugugagauaaaagaagagaagguuggucugucacaaucucaggaaauaacggaucaggcaaauccacaaagccagagaagcuuaaagaaugaaaagcaugggacuggagagacagcucagugguuaagagcauccucugcucucccagagguccugaguucauuucccaacaaccacauggugacucacagccaucuguaaugauaucugaugcccucuucuggugugucugaagaccgugacaguguacucauauauauaaaguaaacaaaucuuugagaaaauaaaauuguggacuccuccacuagcuguagcuuccucacgggugacagggacagaagugaacaagacaagaagcaaggcaugacgcuguauacacuagagaugaaaugugaauccgacucacgaggacugaguuuaccacgcugugggaacagcuaagcugaaucagagauguccugccauggucacccaaagccagcaugugaagagaugaagucucuucuaaacauccugacuacagaaggcaggguguacacccagaagcagguugugugucacagugaaacaaauuagccuauugucaggaagcucaucugugucaccugaaccauguguguucaagcaagaauuuacugagggaaacccaguaacaccaaauaaugcaaagacaagagagguucuuugacacccaggaaaaauacacuuauauaacagguugagcugggagacaaaagcccucacagggccgcccuccagauccccuuuuccuucaauaggcaccguguggccugcuggccacugauucucagaggagauuaacaaauaaaaagccaaucucuugcgaagccugcucauuaaagcaggaagcuaaagucagcuucaaacaaguuuuaacuugcuucaaagccaagacuggaccacaagaaugaaccacauuaagaagagucuagaagggacucuugaaaugcauuauucagaagagccucuauauaggggcacaucacucugcagacaucccaggacgcuaaggucuuugagacugggagaacucccuucugcaacuuacaaagcccugugagaagcauacaagcauuuccccaccaguacugucccuggggcaccgauucagccguuucuugggaaagagaacuugacagagguuugggcauucagucacuugucauuuaagcugcgggagggcugugcucuagcaagaccacugcaaagcacauucacuaaguauuugagcaguuuacaagaacugauuaucauauuaaaauauaacauuaggauauguacuggacgguuuuguguuucaacuugacacaggcuggaguuauaucagagaaaggagcuucaguuggggaaaugccuccaugagauccagcuguaaggcucucaugaucaauuagugaucaagggugggagggccccuugugggugguaccaucucugggcugguagucuuggguugaauaagaaagcaagcugaggggcuggcgagauggcucagcgguuaagagcacugacuguucuuccgaaggucuugaguucaaaucccagcaaccacaugguggcucacaaccacccguaaugagaucugaugcccucuucuggugugucugaagacagcuacaguguaauuagauauaauaauaaauaaaucuuuaaaaaaaagaaaaaaagaaagaaagcugagcaagccaguaaguaacaucccuccauggccucugcaucagcuccugcuucuugaccugcuugaguuccaguccugacuuccuuugguggugaacagcaguguggaaguauaagcagaauaaacccuuuccuccccaacuugcuucuuggucaugauguucgugcaggaauagaaaccugacuaagacaggauguaugcagaaauaaaacuuuaaacacauagaacugucagauucauugugauagaggguaggcugugcaugccaggggcuggagagaggaucaggagccagcaaggaguaguauaauuucagaagacugaaauuuuccagagggcaaggcaugugaaggguggagcucaguagacagugccucgcuccggagccagcucaaggcccuggauucacccccagcuucagggggagaaucuggagcuagugaagacugugaaauggcacaaguggaucugcacacaccccacagauuaaaaugggaaauuugggaauguucuuaugccacaaucuucaaacucuguaacagauggaaaaccaacagcuaccaaccccaggaaaauuggaugguguggugguuugaaaacacuuggcccauggaaaguggcacuauuaggagguguggccuuguuggaauggguguggccuuguuggaggaagggugucacugcaugggcaggcugagauuuccuagugcucaagcuccacccaguucagaagaggagagcuuccuccuggcugccuucagaucaagauguagaacccucagcuccuucuucagcacccugucuaucuagaugcugcccugcuucccaucaugacgaugaggauggacugaaacccugaaacuauaagccagccucaauuaaauguuguccucuauaaaaguugccauggucauggugucuguucauagcaacgaaccccuaaauaagacagauggugugaucccucuccccucugcuuuuuuuguuuguuuguuuguuuuucgagacacgguuucucuguauagcucuggcugaccuggaacucacuuuguagaccaggcuggcuucgaacucagaaauacaccugucucugccucccaagugcugggauuaaagccgugugccaccacugcccggcuuccccucugcucuuaaguuugcauucuacgguugugauaaauaccagguccaaaaggagccaagggaggaaagaguuaaauucaccugacugcauaugcaguucauccuaaaggcagggcauggcagggacuaaaggcaaggucucagaaaccacggagaacacugcuuacuagcuuucuccccguggacagcucaggaccaccugcaccagggaguccacucccaguggucuagucuggugcacaaucauuaaccaagaaauugcccccacagacuugccugcaagccaaucugauagcaaucaagauucccugcccaggugacuccagcuugugucagguugaccaaucaggagccagcaugcucuggcugaugaagauaacuucagaagcccagcaugcauugcagucccgcuaaccagugagaacucagagcucccccuccccuguggauuaguuugauggagacuaagguugaauuuucacuucucucccuguacucugucugccccuaacaaaggacuuuguucuguauuuauugaacagugcaggaaacacauuauuuuauauacaccuaaaauuauauacaauacguguaagauauguauaaugcauauauauacauauacucaugcacauacauauacaugugagagauguauaaacacauaaaaggaagcucaccugcuuaagcugauaaugcuuuccacaagaaucaucagcuaacaagccgggcagugguggcgcacgccuuuaaucccaacacuugggagguagaggcaggcggauuucugaguucaaggccagacuggucuacagaguucguuccaggacagccagggcuacacagagaaccccugucuugaaaaacaaaauaacaacaacaacaacaaaaucagcuaaaaaaaaaaaaugcagugccaggcauaggaaaccuccuuucaaauuggucaggguagcccaagggauuccaaaaacaacacagagauugucaggggcugagaaucagccagcccugcugcugaagacacuuaggacagaagacuuugaugauccaaacuggaucugaccugaaagccucuuucuucccuguauucuagcuuccauggcaccagaaaacaccgugcaagcugccaccagggggaggcaauuaaacagcgcuuuccagcugcagcaccugugagccaggacaauuagcaguauggugagauagacuuggaggucgaguuguuaacccacagcugucugauuggacuuaacaggaggaagauccugccugguacuagaagccaaagcaacuucccagggugaaugaugucaugggccuuagagaagacucuauuaccagcccuuugcuugaacagcgugguuccuugcuacauucugaagguuauacccaccuaucuaugaguguagcuacaaccucucccuuaaaaaauaucucucuuuauagcaaaaaaaaccaccaucucagaaagccacagcuggacagagauaaugaaucacgggggagcugacccccaacagaggcaccuacaucacaauccagcaucuaaaagagaccacagaagagaggaccuaagccuuuugagagccagaauacuaggaggucugccucgagacagccuguccuagaauuggcugcauaaacaagaccagaacaauagugacuucaaugggcacauuagcacugaaggaagaaacuuucccagggucacacauaccacuguauaaagaccuacaggcaacuaaugacuucugggagaagaauuagccuagcccagagaugagcccuguugguuguccagugcaguggucaaccuugaaugcauauacacccaaacaacaaaacaggcccagcagcuugucuucauauauguuugugcagacacauacacacacacauauauauauguaacaaauauaguaaaggacaaagagacuaucuacuugagagagggggaacaugggagggggagacgauguaauucuacuucaauuaaaaacauuugauguuuguucguuuuugaaagaaagcaucacguagggagguggggcuuuaccgaaaucuuuaugagcgacucucaaagggauuauguuaucgaccccagcugacccagaucacaagcaggacuacaaaaagauacuguuaccaaguugauccguguucucucaacauuuaugucagauauuuguuguuaagguugcuuuaaaacccucugguuaaaaaaaaaaaacccucugguugucuucaacaagugaucaacacagguuguguauacacacacacacacaugcauucauaacuccaggccaggggcauugaagaguauguaacuuaagugcuagcugugcauuaggguuuaaaaauuaagauucuguaggaaauaaaagacagguaagguugacuauuguccuaaagguagguuaaguccauaggcuagguggggcugaggugguacacgccuuuaaugacagcauucaccaggcagagacagguggaucucagagaauuuguagaccagccuggucugcacagugaguuccaagccagccagagccauacaacaagacccacagcaagaugucacucaagaccuauuguuaacgggguugugaggccaacaaaaguuccagucuccgaauguaagaggcacuuucauaaaaaugguaucacuauggcuaacccgaguuaaucagauuugaaauuaauuaaguuuggaauguguucugcaaucucuguagaaaauguggcuugcuaagcaagcaacaggucaccaguucugauagauggaaagaugaagacagagcaaacggucugaaacuguggucagugcacacccagcacuagcucggcuguggucuccagauggcuaagugcuccguacacaaggaacucauaaugccauuuuccuauuuaauguuuuguguguugagcguugaguguggauggugcacccucaccugugugcccuuggagaaggaucgcagacauguucccccauugaucuccacugcucugagacaggaucucuugcugaagcugaaguuugcugguuuccagccaggcuaaaccccaggagcucuuugucuccaccuccacccccacuuuuaccccagcaugggauuacagaggagcacacauccccagaacaguguggaguugcuucuccuauguccucaacacaguucuagguccugugucugcgcacuuuugauucuuuuugagaaguauccaguuuccuagcccugcucagggccagcaacuuucuaaacaucacuaaaaaagaaccugcccguuccccauuauguccuggccuuucguuaaauaucaacuggccaccgaugcgugaguuuauccugggcucccugccaugcucagugcaccuguuuuuaggcuuguuuguuccucuuugugguguguuuugaaguggacugaugugaagucccaagcgcuguuccucuuggucugaucacuuugccuauucugaucugccgaagcuugggggcaggaugaccuuguucuacuuuugugggggaaaaaguagcaccgggauugaaucuguaguuuuuaguauugacacuuuggcaaucgucucaccauacacagacacacgaaugagccccguccugcauuccuaacuuccuccguuuccaucagaaacacuucggucucacaucauagcucuuucuccuccuugauucaaucuguugccaauauuugguuuauuuuugaugcuguucuaaaaaaccaaccacuuucugaacucccuuuucagacgguucauuauuggcauaggaaacaccaccaacuuuuaugucaaguccaaaacaaacuggggacaaauggcuaacuguggugccgguuagcucacuguauuugucuguauuagucaggguucucucgagucacagaacauaugggcagucucuguauaguaagggaauuuguugaugucuuacagucugcaguccaacucccaacaauggucaguagcagcucugaauggaaggccaagcaucuagcaguugcucagacccaaacggcaagcaggcgaagaaaagaaagaguaaaucuucccucuuccaauguucuuauguaggccuccagcagauguggcucagauuaaaggugugccaccacuccuuuaaucccagaugaccuugaacucagagaucucccugucuucuggaauucauagccucuacaccucaaggucucccugccaagauccggaucagaaacuucuuucucccagccuccugauuagaaucacuggugagccuuccaauucuggauuguaguucauuccagauacagucaaguugacaaccaggaauagacacuacacucagcaaggccaaugcuggacuccaggcucacucggcaccuuuggcuccucacagcucuucucaccuggccccaacccuaaaccucuccaguugugacuucucuuuccugggcucucauuccaguaacccugcucuuuaggccacguucucucucuucccucucccucucugucuggguccuccuguuccccucucuguucucucccucucccccucccucccucccucccacccucucucuacccccuccucucauggcccaguucacuguacuguccaccaccuucucuuccugcucuggacucuuccaggugccucuagcuguacucuuccuuacaacuacaauaaaaaccuucucuucagccacacccuggagggguugugugcucauuacauuucguuugggguccuaaaacuuuacuauguguuuacuaugaguuuaccaugugucucuaacagguuuuuguggccauuagaccuuucuuuguacacacacacacauggugucuauagacaaggaccauuucacaucuuccuuuccagaguuaaugccuuuucuucugucuggccuuguugcuauggcgagcacuccuagcauuauuuugaauggagucuuucuuagagaaaaccuuucaccccuucugguuacauguucccacuuagcaaugaaggcugggcuacccucaagcuccacccucagaguucagcacagaguccacgggcagcugugagggacaggcagcucccugccuguguccaggaagugaaaagucauuccagaaaagcuaugaaccagcgaccucuggagcaguuacaaaguccuccagcugcuguuuuacugaggcccaucaugcccuccacacugugacccucucacccgcaggcaucuggucucugggacaggcauggcugugugcugugacaagcacuuugggccucacccggcaucagccuugccaggccagguccuuacaagcagcauguccugaacuccagcacaggacuaagagaaugugccucugucuccaggacuccaugcaccaggaguuggcugcagggauggccuccguguggggcacagucaucagccagguuggggaccucuauagcacgaggagguagccugcccccauggccaugcacagcguggcaccgaaggcuccagcuacucaaaaauaagcgugauugggaagagcaugcgacgagagaagagugcugcggaauuugacacauuccuccagugaguugugugacaagaagcuguauggugggacgguuuuuaauuuaccaccuuaguauacugcugugccccacugacucccaugcucaacacgcacauuauacagugugguacgugcacuagcaccggccucacggacacacauauggaacaacucuucuuuccacucucuucagaaugaugucacucugggaagagcauagcagggcauggcgauucgguccacaaacccugggaaaggugaccaggcucacgcuccaccucaacuauucccucaguauguaaacucccugcagacagaaucaggcugaagucugcaagggcucuugaauggcaaggagggagaaugauuagggcacauucuaagggaaaggggccuccugagagggaugcuauguugugccuuggaagauuauggggaggaaggcaaagaaucccagaugcugacaggagcuaaaaugcacacacacacacacacacaucacagacauccaccuuauucacccaaggacauucacuuccaaucuguggaagcuacuuacuugcacaagaggcuauuuaugucugugagcaugaaugauaagguuaaacacuuuuaaagcuaaauauggaaggggcuggaggaauggcucaaaggucaaaagcaccgacugcucuuccauacgacuuguauacaguucccagcacccgaguggugacucucaagggucuguaaugccagucuccaugcccucugcugaguucugugggcacagcaugcacacauggugcaugcagacaaaauagccaugcccauaaaauaaucuguaacuaaagaagaaagccgauccacaaaauucggaaccuuagcuaggcaaguucaguggcagugccacgcuccuugugaccugguaacaccgugacucugcugagcauuacauaaaacaccuagaggagccacauuucauaccugauaacuuaauucugcuuaugccaguaauuuuccaagaaaaugucccccuuagaaaguuuccaggcucaagaguuuucaguaaaauucuaauaaccuggggcuggcaagauggcucagugggcgugcaaggcugaugaucugugcucuguccccagaggccacaacaccacaaaacuguccucugaccugcauaugacacuguggcaugcaugugccugucuacaacacaugugugcacacacaugcaugcacacauguacaugcaugcacacacuugcacacacacaaaggaaaaaaaaacccacaugcauaguaaagguuuuuguuuguuuguuuguuuuuaacucuaauaguuuuugagcauuccacaaaaugcgugcggcaaaagcaaacacauagaacuucuaguuuccuggaacccguggcuuccauuucuccacauauguacuagaugagagagaaagccugugaacaaagaccagccacaaagcccucugagucuucaagucaggaugcccugcccagcggugacagaacuuuuaaguuacaaaagccucaggcucugaggaaaucaaguugcccuucaaaauagucuuuaccgaggcacaaaaggugcccauacagccugaugucugggagauucugaaguacccaugacagcgaugacagcguauggcagaccucacccuguaacaaaggggaaaacacaacaagaagccuaccccaggggugcuaaagcggaugcgcggguaccuccuaucccuguccacagcccaccuaaaaaagucuuacaaagauagacgagggagaggaugaaaccaagacugcuaaccucagaaccaggagugcuccuggaagacuggauccucaauccaggcuuucagggagggagccgcccuuucacucccaaacaccugcaucccccugacccucccgcaagcaaaagccacgugcucuauuccaagauccccagcucccaacugccagcggcagcaauagcaacaucaccggguaagagagcugguacuuggcccacccccucccccuccccuccccugccccuccccucccccacccccacccucuacgaaggcauguaaacacucaacaagcccagcugggacaaucuuugcaaggaggcacaacugagugccccaaaauggcuaaagccuguucaguucacugcaggucugggcccaggaaguagaacuuagcauggagaugaugcuuauuagcaucuauuugcuaauagcagguuacaucaccauccuguuggcagcucugaucacccaugaccugcgagugccccucucucuaucagagcacuuuagaaaggggugugaguaaccaaagcauaaugggggcaugccuguacccagacagagauggucuguaucccacuugccugccccugggcuacugcaccaagagauauagauaaguugcuuuaaaaaucagcaagcaccuccuuccacacccagccacacccagcaugcuccaggugcuaagcauucggcuuugacuuugucuuuuuuuguuuguuuguucuguuuuuuugagacaggguuucucuguguagcccuggcuguccuggaacucacuuuguagaccaggcuggccuugaacucagaaauccaccugccucugccucugccucccaagugcugggauuaaaggcgugcgucaccacgcccggcuuggcuuuaacuuugucaagagucaaacacaaacuaaccaagugcuauggcucugacuacugcacgucccaaagcccucacaggugugugccugccaccccuccccccaaccugccugucgcggcaagcugguuuugguuugcuaugcuaaagggucaauuggggagagggcagggauuuuaaacaguacacaaugcaggaaaagguaacccuuuaggguagauguuccacacagaaucccgaacaauauuaacccgucuucucugcucccuccaggcgacuggcagcccagcaaagcaggcacaaaguuggugauauggaccacuguugacucuguaccuuguuccccugagcauguguacacagacaucaagaaugugaagagggggccuggccacccggcaaggcucccgucaucugccuucacacuuaggcuuccaggaacacaaaagcagccgaggaggccuggaaaugaguugaacggcucccgcccccacagagggaaucagcaaguucucaggcaguguuacaaaauccccugcugaccaacauuccggauucaucauauccucggccuugacgaagaaaguggcuccacccaccaaauugaaacagcuagcggggacacaguuacccugugcugugucggccacacaucuaucgcuacuccagaaacauuaagagguguggggaaagcugaccaauucugcuuucuccucuuacaaacccagagcagcaggcaagccauuuaagccaagcguagaggcggagcucugucggaggcuggaaaaggaguccagagucugacuagucuugacucugagauauugcauucaugagugcucaguggcagguagacagccugagaaaacucggaggcucugccugcaacgcggaguaaagaccagagccaaaggaaagacagggaaaguagaaaucaguccauuucccacgguggcuaaguaaggaacggggaagacagaggagggagggaagcuccccagaccuucacuaacucagcuugaucagaauguauuacauagccaacagauugauacgcgcaagacaaggagucagggauuaggagcgaggcuuuugaguacaucacucuuuuuugguuuuucaagacggguuucucuguauagcccuggcuguccuggaacucacucuguagaccaggguggccucgaacucagaaauccuccugccucugccucccaagugcugggauuaaaggcgugcgccaccacacuuuacacaacauaaaaagucagaacuugggaguuucauacauuggaaaccucucucccugaaacuauaccauacuauuuccggguucguuuguuucacuuaaaguaucuuauuucuuuaucauggaaaagggagaagacagaagcaaauuaaucgggaaaguccaagacgaaguuguacacgcacuaaaaauaauucacuaccuaucuuaaaaaugccaguacaggaagcuauuccacucacgugacuugcgcaccagccaagacucggcacuggguaaauaaccgugagucgaggaggcugggcgauuccaacucuacuucccagucgccuuacauccagcagagugguccaacgcucucugacucaguuuccucguucauaaagaagucgguaauagcagcggugcucaacucccaaggcugcuuuguacaccaaaggagggcacccugagggggacauuaaagcaccuaagaagcgagagucguacugaucggagaucucucccaggauaacccgaaucuucgcgaagacgcacagagugcugcugaacuggagauuuucucaaucggcaaagcaaggcaagugggaacagaggugcaaugaaugucacagcccaaaguggagaccccgcggcugcccacagacgacuccucgaccccgcagagccccgaagcccgccugucccggcggcgccgcccucaccugcggugucccauauggagauguugaaggaacgccacugcuucagguagaaggcgccgcccacggugcugaccguguccgggaagcgacgcuccauguagcgcugcagcagcgacguuuuacccacguucaugucccccagcaguacgaucuucccauccggcuuccgcau

SEQ ID NO: 12139 - RNA, 24524 nt, Mus musculus
augcggaagccggaugggaagaucguacugcugggggacaugaacguggguaaaacgucgcugcugcagcgcuacauggagcgucgcuucccggacacggucagcaccgugggcggcgccuucuaccugaagcaguggcguuccuucaacaucuccauaugggacaccgcaggugagggcggcgccgccgggacaggcgggcuucggggcucugcggggucgaggagucgucugugggcagccgcggggucuccacuuugggcugugacauucauugcaccucuguucccacuugccuugcuuugccgauugagaaaaucuccaguucagcagcacucugugcgucuucgcgaagauucggguuauccugggagagaucuccgaucaguacgacucucgcuucuuaggugcuuuaaugucccccucagggugcccuccuuugguguacaaagcagccuugggaguugagcaccgcugcuauuaccgacuucuuuaugaacgaggaaacugagucagagagcguuggaccacucugcuggauguaaggcgacugggaaguagaguuggaaucgcccagccuccucgacucacgguuauuuacccagugccgagucuuggcuggugcgcaagucacgugaguggaauagcuuccuguacuggcauuuuuaagauagguagugaauuauuuuuagugcguguacaacuucgucuuggacuuucccgauuaauuugcuucugucuucucccuuuuccaugauaaagaaauaagauacuuuaagugaaacaaacgaacccggaaauaguaugguauaguuucagggagagagguuuccaauguaugaaacucccaaguucugacuuuuuauguuguguaaagugugguggcgcacgccuuuaaucccagcacuugggaggcagaggcaggaggauuucugaguucgaggccacccuggucuacagagugaguuccaggacagccagggcuauacagagaaacccgucuugaaaaaccaaaaaagagugauguacucaaaagccucgcuccuaaucccugacuccuugucuugcgcguaucaaucuguuggcuauguaauacauucugaucaagcugaguuagugaaggucuggggagcuucccucccuccucugucuuccccguuccuuacuuagccaccgugggaaauggacugauuucuacuuucccugucuuuccuuuggcucuggucuuuacuccgcguugcaggcagagccuccgaguuuucucaggcugucuaccugccacugagcacucaugaaugcaauaucucagagucaagacuagucagacucuggacuccuuuuccagccuccgacagagcuccgccucuacgcuuggcuuaaauggcuugccugcugcucuggguuuguaagaggagaaagcagaauuggucagcuuuccccacaccucuuaauguuucuggaguagcgauagauguguggccgacacagcacaggguaacuguguccccgcuagcuguuucaauuugguggguggagccacuuucuucgucaaggccgaggauaugaugaauccggaauguuggucagcaggggauuuuguaacacugccugagaacuugcugauucccucugugggggcgggagccguucaacucauuuccaggccuccucggcugcuuuuguguuccuggaagccuaagugugaaggcagaugacgggagccuugccggguggccaggcccccucuucacauucuugaugucuguguacacaugcucaggggaacaagguacagagucaacagugguccauaucaccaacuuugugccugcuuugcugggcugccagucgccuggagggagcagagaagacggguuaauauuguucgggauucuguguggaacaucuacccuaaaggguuaccuuuuccugcauuguguacuguuuaaaaucccugcccucuccccaauugacccuuuagcauagcaaaccaaaaccagcuugccgcgacaggcagguuggggggagggguggcaggcacacaccugugagggcuuugggacgugcaguagucagagccauagcacuugguuaguuuguguuugacucuugacaaaguuaaagccaagccgggcguggugacgcacgccuuuaaucccagcacuugggaggcagaggcagaggcagguggauuucugaguucaaggccagccuggucuacaaagugaguuccaggacagccagggcuacacagagaaacccugucucaaaaaaacagaacaaacaaacaaaaaaagacaaagucaaagccgaaugcuuagcaccuggagcaugcuggguguggcuggguguggaaggaggugcuugcugauuuuuaaagcaacuuaucuauaucucuuggugcaguagcccaggggcaggcaagugggauacagaccaucucugucuggguacaggcaugcccccauuaugcuuugguuacucacaccccuuucuaaagugcucugauagagagaggggcacucgcaggucaugggugaucagagcugccaacaggauggugauguaaccugcuauuagcaaauagaugcuaauaagcaucaucuccaugcuaaguucuacuuccugggcccagaccugcagugaacugaacaggcuuuagccauuuuggggcacucaguugugccuccuugcaaagauugucccagcugggcuuguugaguguuuacaugccuucguagagggugggggugggggaggggaggggcaggggaggggagggggagggggugggccaaguaccagcucucuuacccggugauguugcuauugcugccgcuggcaguugggagcuggggaucuuggaauagagcacguggcuuuugcuugcgggagggucagggggaugcagguguuugggagugaaagggcggcucccucccugaaagccuggauugaggauccagucuuccaggagcacuccugguucugagguuagcagucuugguuucauccucucccucgucuaucuuuguaagacuuuuuuaggugggcuguggacagggauaggagguacccgcgcauccgcuuuagcaccccugggguaggcuucuuguuguguuuuccccuuuguuacagggugaggucugccauacgcugucaucgcugucauggguacuucagaaucucccagacaucaggcuguaugggcaccuuuugugccucgguaaagacuauuuugaagggcaacuugauuuccucagagccugaggcuuuuguaacuuaaaaguucugucaccgcugggcagggcauccugacuugaagacucagagggcuuuguggcuggucuuuguucacaggcuuucucucucaucuaguacauauguggagaaauggaagccacggguuccaggaaacuagaaguucuauguguuugcuuuugccgcacgcauuuuguggaaugcucaaaaacuauuagaguuaaaaacaaacaaacaaacaaaaaccuuuacuaugcauguggguuuuuuuuuccuuugugugugugcaagugugugcaugcauguacaugugugcaugcaugugugugcacacauguguuguagacaggcacaugcaugccacagugucauaugcaggucagaggacaguuuugugguguuguggccucuggggacagagcacagaucaucagccuugcacgcccacugagccaucuugccagccccagguuauuagaauuuuacugaaaacucuugagccuggaaacuuucuaagggggacauuuucuuggaaaauuacuggcauaagcagaauuaaguuaucagguaugaaauguggcuccucuagguguuuuauguaaugcucagcagagucacgguguuaccaggucacaaggagcguggcacugccacugaacuugccuagcuaagguuccgaauuuuguggaucggcuuucuucuuuaguuacagauuauuuuaugggcauggcuauuuugucugcaugcaccaugugugcaugcugugcccacagaacucagcagagggcauggagacuggcauuacagacccuugagagucaccacucgggugcugggaacuguauacaagucguauggaagagcagucggugcuuuugaccuuugagccauuccuccagccccuuccauauuuagcuuuaaaaguguuuaaccuuaucauucaugcucacagacauaaauagccucuugugcaaguaaguagcuuccacagauuggaagugaauguccuugggugaauaagguggaugucugugaugugugugugugugugugugcauuuuagcuccugucagcaucugggauucuuugccuuccuccccauaaucuuccaaggcacaacauagcaucccucucaggaggccccuuucccuuagaaugugcccuaaucauucucccuccuugccauucaagagcccuugcagacuucagccugauucugucugcagggaguuuacauacugagggaauaguugagguggagcgugagccuggucaccuuucccaggguuuguggaccgaaucgccaugcccugcuaugcucuucccagagugacaucauucugaagagaguggaaagaagaguuguuccauauguguguccgugaggccggugcuagugcacguaccacacuguauaaugugcguguugagcaugggagucaguggggcacagcaguauacuaaggugguaaauuaaaaaccgucccaccauacagcuucuugucacacaacucacuggaggaaugugucaaauuccgcagcacucuucucucgucgcaugcucuucccaaucacgcuuauuuuugaguagcuggagccuucggugccacgcugugcauggccaugggggcaggcuaccuccucgugcuauagagguccccaaccuggcugaugacugugccccacacggaggccaucccugcagccaacuccuggugcauggaguccuggagacagaggcacauucucuuaguccugugcuggaguucaggacaugcugcuuguaaggaccuggccuggcaaggcugaugccgggugaggcccaaagugcuugucacagcacacagccaugccugucccagagaccagaugccugcgggugagagggucacaguguggagggcaugaugggccucaguaaaacagcagcuggaggacuuuguaacugcuccagaggucgcugguucauagcuuuucuggaaugacuuuucacuuccuggacacaggcagggagcugccugucccucacagcugcccguggacucugugcugaacucugaggguggagcuugaggguagcccagccuucauugcuaagugggaacauguaaccagaaggggugaaagguuuucucuaagaaagacuccauucaaaauaaugcuaggagugcucgccauagcaacaaggccagacagaagaaaaggcauuaacucuggaaaggaagaugugaaaugguccuugucuauagacaccauguguguguguguacaaagaaaggucuaauggccacaaaaaccuguuagagacacaugguaaacucauaguaaacacauaguaaaguuuuaggaccccaaacgaaauguaaugagcacacaaccccuccaggguguggcugaagagaagguuuuuauuguaguuguaaggaagaguacagcuagaggcaccuggaagaguccagagcaggaagagaaggugguggacaguacagugaacugggccaugagaggaggggguagagagagggugggagggagggagggagggggagagggagagaacagagaggggaacaggaggacccagacagagagggagagggaagagagagaacguggccuaaagagcaggguuacuggaaugagagcccaggaaagagaagucacaacuggagagguuuaggguuggggccaggugagaagagcugugaggagccaaaggugccgagugagccuggaguccagcauuggccuugcugaguguagugucuauuccugguugucaacuugacuguaucuggaaugaacuacaauccagaauuggaaggcucaccagugauucuaaucaggaggcugggagaaagaaguuucugauccggaucuuggcagggagaccuugagguguagaggcuaugaauuccagaagacagggagaucucugaguucaaggucaucugggauuaaaggagugguggcacaccuuuaaucugagccacaucugcuggaggccuacauaagaacauuggaagagggaagauuuacucuuucuuuucuucgccugcuugccguuugggucugagcaacugcuagaugcuuggccuuccauucagagcugcuacugaccauuguugggaguuggacugcagacuguaagacaucaacaaauucccuuacuauacagagacugcccauauguucugugacucgagagaacccugacuaauacagacaaauacagugagcuaaccggcaccacaguuagccauuuguccccaguuuguuuuggacuugacauaaaaguuggugguguuuccuaugccaauaaugaaccgucugaaaagggaguucagaaagugguugguuuuuuagaacagcaucaaaaauaaaccaaauauuggcaacagauugaaucaaggaggagaaagagcuaugaugugagaccgaaguguuucugauggaaacggaggaaguuaggaaugcaggacggggcucauucgugugucuguguauggugagacgauugccaaagugucaauacuaaaaacuacagauucaaucccggugcuacuuuuucccccacaaaaguagaacaaggucauccugcccccaagcuucggcagaucagaauaggcaaagugaucagaccaagaggaacagcgcuugggacuucacaucaguccacuucaaaacacaccacaaagaggaacaaacaagccuaaaaacaggugcacugagcauggcagggagcccaggauaaacucacgcaucgguggccaguugauauuuaacgaaaggccaggacauaauggggaacgggcagguucuuuuuuagugauguuuagaaaguugcuggcccugagcagggcuaggaaacuggauacuucucaaaaagaaucaaaagugcgcagacacaggaccuagaacuguguugaggacauaggagaagcaacuccacacuguucuggggaugugugcuccucuguaaucccaugcugggguaaaaguggggguggagguggagacaaagagcuccugggguuuagccuggcuggaaaccagcaaacuucagcuucagcaagagauccugucucagagcaguggagaucaaugggggaacaugucugcgauccuucuccaagggcacacaggugagggugcaccauccacacucaacgcucaacacacaaaacauuaaauaggaaaauggcauuaugaguuccuuguguacggagcacuuagccaucuggagaccacagccgagcuagugcugggugugcacugaccacaguuucagaccguuugcucugucuucaucuuuccaucuaucagaacuggugaccuguugcuugcuuagcaagccacauuuucuacagagauugcagaacacauuccaaacuuaauuaauuucaaaucugauuaacucggguuagccauagugauaccauuuuuaugaaagugccucuuacauucggagacuggaacuuuuguuggccucacaaccccguuaacaauaggucuugagugacaucuugcugugggucuuguuguauggcucuggcuggcuuggaacucacugugcagaccaggcuggucuacaaauucucugagauccaccugucucugccuggugaaugcugucauuaaaggcguguaccaccucagccccaccuagccuauggacuuaaccuaccuuuaggacaauagucaaccuuaccugucuuuuauuuccuacagaaucuuaauuuuuaaacccuaaugcacagcuagcacuuaaguuacauacucuucaaugccccuggccuggaguuaugaaugcauguguguguguguguauacacaaccuguguugaucacuuguugaagacaaccagaggguuuuuuuuuuuuaaccagaggguuuuaaagcaaccuuaacaacaaauaucugacauaaauguugagagaacacggaucaacuugguaacaguaucuuuuuguaguccugcuugugaucugggucagcuggggucgauaacauaaucccuuugagagucgcucauaaagauuucgguaaagccccaccucccuacgugaugcuuucuuucaaaaacgaacaaacaucaaauguuuuuaauugaaguagaauuacaucgucucccccucccauguucccccucucucaaguagauagucucuuuguccuuuacuauauuuguuacauauauauauguguguguguaugugucugcacaaacauauaugaagacaagcugcugggccuguuuuguuguuuggguguauaugcauucaagguugaccacugcacuggacaaccaacagggcucaucucugggcuaggcuaauucuucucccagaagucauuaguugccuguaggucuuuauacagugguaugugugacccugggaaaguuucuuccuucagugcuaaugugcccauugaagucacuauuguucuggucuuguuuaugcagccaauucuaggacaggcugucucgaggcagaccuccuaguauucuggcucucaaaaggcuuagguccucucuucuguggucucuuuuagaugcuggauugugauguaggugccucuguugggggucagcucccccgugauucauuaucucuguccagcuguggcuuucugagauggugguuuuuuuugcuauaaagagagauauuuuuuaagggagagguuguagcuacacucauagauagguggguauaaccuucagaauguagcaaggaaccacgcuguucaagcaaagggcugguaauagagucuucucuaaggcccaugacaucauucacccugggaaguugcuuuggcuucuaguaccaggcaggaucuuccuccuguuaaguccaaucagacagcuguggguuaacaacucgaccuccaagucuaucucaccauacugcuaauuguccuggcucacaggugcugcagcuggaaagcgcuguuuaauugccucccccugguggcagcuugcacgguguuuucuggugccauggaagcuagaauacagggaagaaagaggcuuucaggucagauccaguuuggaucaucaaagucuucuguccuaagugucuucagcagcagggcuggcugauucucagccccugacaaucucuguguuguuuuuggaaucccuugggcuacccugaccaauuugaaaggagguuuccuaugccuggcacugcauuuuuuuuuuuuagcugauuuuguuguuguuguuguuauuuuguuuuucaagacagggguucucuguguagcccuggcuguccuggaacgaacucuguagaccagucuggccuugaacucagaaauccgccugccucuaccucccaaguguugggauuaaaggcgugcgccaccacugcccggcuuguuagcugaugauucuuguggaaagcauuaucagcuuaagcaggugagcuuccuuuuauguguuuauacaucucucacauguauauguaugugcaugaguauauguauauauaugcauuauacauaucuuacacguauuguauauaauuuuagguguauauaaaauaauguguuuccugcacuguucaauaaauacagaacaaaguccuuuguuaggggcagacagaguacagggagagaagugaaaauucaaccuuagucuccaucaaacuaauccacaggggagggggagcucugaguucucacugguuagcgggacugcaaugcaugcugggcuucugaaguuaucuucaucagccagagcaugcuggcuccugauuggucaaccugacacaagcuggagucaccugggcagggaaucuugauugcuaucagauuggcuugcaggcaagucugugggggcaauuucuugguuaaugauugugcaccagacuagaccacugggaguggacucccuggugcaggugguccugagcuguccacggggagaaagcuaguaagcaguguucuccgugguuucugagaccuugccuuuagucccugccaugcccugccuuuaggaugaacugcauaugcagucaggugaauuuaacucuuuccucccuuggcuccuuuuggaccugguauuuaucacaaccguagaaugcaaacuuaagagcagaggggaagccgggcagugguggcacacggcuuuaaucccagcacuugggaggcagagacagguguauuucugaguucgaagccagccuggucuacaaagugaguuccaggucagccagagcuauacagagaaaccgugucucgaaaaacaaacaaacaaacaaaaaaagcagaggggagagggaucacaccaucugucuuauuuagggguucguugcuaugaacagacaccaugaccauggcaacuuuuauagaggacaacauuuaauugaggcuggcuuauaguuucaggguuucaguccauccucaucgucaugaugggaagcagggcagcaucuagauagacagggugcugaagaaggagcugaggguucuacaucuugaucugaaggcagccaggaggaagcucuccucuucugaacuggguggagcuugagcacuaggaaaucucagccugcccaugcagugacacccuuccuccaacaaggccacacccauuccaacaaggccacaccuccuaauagugccacuuuccaugggccaaguguuuucaaaccaccacaccauccaauuuuccugggguugguagcuguugguuuuccaucuguuacagaguuugaagauuguggcauaagaacauucccaaauuucccauuuuaaucuguggggugugugcagauccacuugugccauuucacagucuucacuagcuccagauucucccccugaagcugggggugaauccagggccuugagcuggcuccggagcgaggcacugucuacugagcuccacccuucacaugccuugcccucuggaaaauuucagucuucugaaauuauacuacuccuugcuggcuccugauccucucuccagccccuggcaugcacagccuacccucuaucacaaugaaucugacaguucuauguguuuaaaguuuuauuucugcauacauccugucuuagucagguuucuauuccugcacgaacaucaugaccaagaagcaaguuggggaggaaaggguuuauucugcuuauacuuccacacugcuguucaccaccaaaggaagucaggacuggaacucaagcaggucaagaagcaggagcugaugcagaggccauggagggauguuacuuacuggcuugcucagcuuucuuucuuuuuuucuuuuuuuuaaagauuuauuuauuauuauaucuaauuacacuguagcugucuucagacacaccagaagagggcaucagaucucauuacgggugguugugagccaccaugugguugcugggauuugaacucaagaccuucggaagaacagucagugcucuuaaccgcugagccaucucgccagccccucagcuugcuuucuuauucaacccaagacuaccagcccagagaugguaccacccacaaggggcccucccacccuugaucacuaauugaucaugagagccuuacagcuggaucucauggaggcauuuccccaacugaagcuccuuucucugauauaacuccagccugugucaaguugaaacacaaaaccguccaguacauauccuaauguuauauuuuaauaugauaaucaguucuuguaaacugcucaaauacuuagugaaugugcuuugcaguggucuugcuagagcacagcccucccgcagcuuaaaugacaagugacugaaugcccaaaccucugucaaguucucuuucccaagaaacggcugaaucggugccccagggacaguacugguggggaaaugcuuguaugcuucucacagggcuuuguaaguugcagaagggaguucucccagucucaaagaccuuagcguccugggaugucugcagagugaugugccccuauauagaggcucuucugaauaaugcauuucaagagucccuucuagacucuucuuaaugugguucauucuugugguccagucuuggcuuugaagcaaguuaaaacuuguuugaagcugacuuuagcuuccugcuuuaaugagcaggcuucgcaagagauuggcuuuuuauuuguuaaucuccucugagaaucaguggccagcaggccacacggugccuauugaaggaaaaggggaucuggagggcggcccugugagggcuuuugucucccagcucaaccuguuauauaaguguauuuuuccugggugucaaagaaccucucuugucuuugcauuauuugguguuacuggguuucccucaguaaauucuugcuugaacacacaugguucaggugacacagaugagcuuccugacaauaggcuaauuuguuucacugugacacacaaccugcuucuggguguacacccugccuucuguagucaggauguuuagaagagacuucaucucuucacaugcuggcuuugggugaccauggcaggacaucucugauucagcuuagcuguucccacagcgugguaaacucaguccucgugagucggauucacauuucaucucuaguguauacagcgucaugccuugcuucuugucuuguucacuucugucccugucacccgugaggaagcuacagcuaguggaggaguccacaauuuuauuuucucaaagauuuguuuacuuuauauauaugaguacacugucacggucuucagacacaccagaagagggcaucagauaucauuacagauggcugugagucaccaugugguuguugggaaaugaacucaggaccucugggagagcagaggaugcucuuaaccacugagcugucucuccagucccaugcuuuucauucuuuaagcuucucuggcuuuguggauuugccugauccguuauuuccugagauugugacagaccaaccuucucuucuuuuaucucacacacacacacacacacacacacacacacacacucucucucucucucucuugcaugugcuguaugguugugugaggaugacguggggugucuuccccagcuaucaccuucuuuagacuuugaggcagggucucucacugaaccugaggcucauaaguuuagcuagacagacuggccccagggaucagccuaucuuuguucucagugccagggucacaggagcacauugccauacaucgcuuuaucaucuggguuuuaggucauccaaacucaggucuuacugcuugugagcaagcacuucacugacagagccacuucugaggccaccagccuucuuuuccugacaucuguuuccucaacauuucagauuaggacccgagguugacaguguacaugguaugaggaucagggaccugaacucugacuguaaccuucccuacugccuauguggccauggcuccugugaucauagcccagcucuguuucacuggcuuuaaugcccuagguccuaugguggccaccuuggcgcuuacuguucaguucaguacgggccagcugcauccucacaggccucagggcagcuucugucccuaccaugcagcuggaggcuaguuuugaccuguagguccuuagucucuugcacagcuguucaggguuacaccucuucauccuuguguuuguccggagugauaaagaaaccaggcuuggcucuuuauuucucaagaagucagaagggagggcaaaggucguucuuucuaguuuggauccgguuuaagguugagaaacaaagucacaugcugaugucucugggaaucucuguacuugguuaaguccugugcucaggaagugaguggcuuugcugagcugguucaggaguagcauucggguuuuugugacgcaaguccagugucauguguuccauucuuaccaauuucucuuccuucacugaaguuugugauuggcuugucuugguuuugaaggugggacaagggauggcuggccuggauggaaggaacaccccuugcccgucucaccccugugcacggaggaaaaggaaguaugauugucgauggguucaugguuucugacuuccugaugagggugaaagguggcggccuccagucuaggcccgaguagcccagggcugcuuuagggaguuucacacugucuguggcuuaccacaauagaaacugauucucuugaaauucuggaguuggaugucugaaguccaggugcugguggcuggcuucaccacagagcaaaaaccaaaugucucccuccucugggggaucuucacgguccuguccccgaggccucacuauuccucuaugugucugacccuccucuucuugcagagccaugacucacagccugcugagcacugggcacuguccagugugauguggugagcuuagcuaaucaucucccccagagaaggucacagacacaggguggaaaugagaacuugaguuaucuuuuaggagcauaguugaagcuacauuagugaccguaguguaaauuuaucuauuuuuggacaugagugguggugguuugaccuucugcucaccuuucaagguggaagugaaagccaggauucuguguaaggcuucugagaagguguacugucuuaggugccacuugccaucuggggcugagaacagggcauggggcaggguuuccuggcuauccguagagucuuaguugcccaugacaaguggaaagaaggacugugaggcugggacaggcaagacagauuccaggggacugggauugcuggcaucuguggccuggcuugugaugaggaaaggggaaaagauacaggcuugauuggcaccugacugaggguugggaggacugaagaugcuggugccauuuucuccuuccuagccuccuuccugugaggcuggagcacacccugguucugggaacugggcacacaggugcauuuggccucugccucagagaauuuaaguccaucuucucugccuaaacacagccauggucacgugugaacugaacagugguggugucacacggaguaaaauacacucugguuuagaagugguggcacaauagcuuucuguggacuguauauugaaguaaagauaaaaaauuaugugggucagcugggcagugguggcacaagccuuuaaucccagcccuugggaggcagaagcaggcagauuucugaguucaaggccagucuggucuacagagugaguuccaggacagccagggcuacacagagaaacccugugucaaaaaauguguuuuguguguguucguaugugugcacaugcauguaugugcacugcauauguauauagaugccagaggucaacgacaucuugccauuccccaagaugucguucaccuuguuuuugagacagggacucuucacugacuugggacuugcugaguuggcuaggcugcugccaacauccuccugucuucgccagcacacccuggcuuuauaccugagcucugggaugggacucaggccucauguuuguacaguaagcacuuugcuggcugagccaucauccccagcucuacccuuuuaaacuuaaguguggcagucagcaacuauuguaugggguugggguagcuuuguuguuguuguuggauggugcuggccauccagugauuaaaaauaauaggaaccauuuaaaaaccauucauugcuucccauguuuaaccacagcgugcaggaaggaaugagcaaguguuaauuauggaggcugaaauggucagaggagccuggagauggaggggacggagagacgguggagagcauuagguccugcuggggaaguggaggguuaggcuguaaagggcaaugggacagggguggggaggaguggagggaggguuaggcuacaaagggauagugggggaaguuugaggcuaggcuggaaaggagcaauggggaguggguauuggaugccaggugagagaugcagccauuggccuuggaguggggguucacggagugacacagggggucauggggggggguuguugagugauuuggcugugucauauccacauggccuuugggacucacaggccucgugcugagagugagcugcuuaccuggaaaggcccucuggguagaaagugauggauugaggccuggaaccagggcugccucccagcccgggaaccugcugaucugguuccugugcagauggccuggaggucugguuuugaugguuuccuggugacuguccugcaggcagugcugagacaaggccaccaaggaccugccugugucugccugacaucagugaucuggcacccagccccagcugaaagcuaccucccagaugacagcagggcagaaaaagcugagauuccugcuguuggugacuuggagagcauugggcucuggagacaacugugacagagaccacagaugaguggaaucaagcugcagaggcugggggacugaauuagugaccaaccuuccuaacgccaggacccuuuaacaguuucucguguugcgguguccuacaaccauaaaaucaucuucguugcuauuucauguuacuacugcugugaaucauaauguaaaugaaaucucuguguuuuuuccaauggucuuagaugaccccugugaaagggccauuuggcuuccaaaagaauuguaaccaacagguugagaacugcugguguagaccagcggcugagucacuccagucuuugucuccagggucauggggucuucucuucugugugugucuucugugggcacuuguaauaggauuuagggcuguugggauaauucagaaaacuuuuuagacccuagcuuuauuucccaauuagauucuauacauggguucuagggaugaggguggggacaugucuuuggauuuaugauauagaaaauucccuuucuugggacauaugcuuaaaggauaagaaaggaggaggaagccacugaaaaaggcagaaaaaauagcuuggauuuuagauuucuuguucuauuuccauuaccccagaccccuuuaucugugaaguguagucccagacuugaggcuggcugcugauucugugagcccugccuucuccucugggcccucuuagugaacucugaaggcggaacugguguuggacagcugccaggccgguggcuccucauacuuugaaagcugaggggggucugugugugcugcaggggauuuccaguagaaacuaccagcuaggucagcaggucaggaagagacugccaauggggaaguggucaguggagggguauugcugugaagggacacaaugaccaaggaaacuaugaaaggaagcauugaacuggggcuugcuuauagcuucagaggucuagucuauuaucauuaugguagugagggcauggugcacgcaggcaugcauguuguuggagugguaaugucagaugggcugcccuaccucaggcaguacaugcagaguguggagauauuacauccuggccacagggagaaaaagagagacacaccggaccugaugggggcuuuugaaacaucaaagcucaccucccuggaccagcaugcuuccuccaaguaggccacagcuacauggucuuuuaauccuucuaauccuuucaaacagcuccacucccuggugacuaggcauuuaaauauauaacacuaugggggccauucucauucaaaccaucacagggcagagcacuacuucugguguuugaaagugcacagcauuguggggagucagaucagguguaugcgggucuagucacccuggaaacuacagcucucugacacugugccuauguguguguguugggaaugaaccuugaugguugaccuagagaugauguaccagaaagucaggaugcugagaccacuuauacuucauggggaaccucacaguuaaacaccuuuuuuuccugagcaacaggucuuaugaagccaaaacaucacucuuguaguauuagggccuucccucagggaauagcucagguugagaucuaaggaggaugccuggauuucugccugggugcugggaacuuccuaggggauuccugaaccugaguacuaaguuacagaaggucccagcucaucugugacacugucaggaacagcuagacaucguuggaccagacucuggcuuguggucugucugagguagguugugccaugauaucauugguaguacuauuuguuugguuguuuuuagggacaggaucuuuuuuacaaaguccuggcuguccugagcucacuauauagaccaggcuggccuugagcucacagggaucuacccacauacugaagggcuugcgaauccuccugugugcugagaguaaggcgugcacuaucacaucuuccauauuguucccugagagaagcccuggugcaugaaagagucucagauaaagccuguuggugggcacuaagguccuguggcuuacuacuccacacucuguauuuacuaccugagguggggacaguggguccucgggcagcccaucucaugaauccagugguugcucaacuuuccuauuccugcgacccuuuaauacaguuccuuauguuguggugacccccgaccguaaaauuauuuguguugcuacuucauaacuguaauuuugcuacaguugugaaucauaacguaaacaccugcgucuucugauggucuugacgaccccugugaaagggccguucaaucuuaaagauguugagacccacagguugagaaccacugacccagggagccauguggcccauuuuuccuugcugcaugaagauuuaauuauuuggcuuugcaaacauuccuggagagccgugacuuccaccgggcaucccagcaucagauacuuuaagaauguucuagcucuuguguacuaaaggaaguugauggcuggcuguagauguuuaaaauucacuggacuucaugaaguggaacucaguaaccuuucugguagccccugcggguugagcuugaaaacacugggguaaucguaauuucaugcaaacaaaguauacaggaaggcacaucagggcucaacccaggcugagccaugcgggccuccaaggcugagcucauggcucugaccuuuguccuugcucccaucucugcuuacaugacucuuuggcuucuccuuguuuacaccauuacagggacucugccagcuuccagcuaauaggcuauggggaugcuuguggcagagcuugcuugacaaaacucccccuuucucugggcuggcccggagcuuauagaagugaucugagucucacguuucagcagcuacuuaaaaaaaaaauguguuuauuuucucugguuuuggguaauggaacccagacaagugccgcacauuguaucuaucuccugauccauguggaucuagggucagagugucgggcauuuuugaaagugccaccccccugugccccacucauugagaguaugcagguaggguuaucugugauuucugaaggacaaaccaacccauucagugauauggaacacggaaguaaaauucacaauauuuggacucaaaaacuggcuguggggacuggggaguguggcagagaguggcugggcuguuuacagagcccugggagcugacccggguuauuguagggcauuucccuagguuugcccuugggccuuuuuaacccuuuuuaaacccugaaucagagaagcaccagcacuggggagaaaguccuuuucaagaacuagggagacacagagcaugggucagcugccccggugaccagccagccgcagagacagugugcagauguguaugugagauaguagacccugacuguguguggaacucacacacagaggggugagggggaggagucaaacucgauguagugaucacaugcuagguacagugcuaagcuguuuaccaggacaaacucauucuguuuucucaaccauuccuaacagaugcuaccgcauuucagcaguagggaaacuuacauugagaggcuugccuggcucacagggacuuucugugucaauuuuggaauccccgggaagucgucaaauguuaguucucaaggaagccaagcugcuuggcuagggacccaggaaccuagugggaaggagacagggcggggggggggagggggggggaaaugacaugcucuuguccuaccagggggaggggugucgggggagggccucgggaccugcucaagccugccugacugggcacaaguucacagaugagggcacagaugaggaauguuacauaugaaggcaaagcgaguuuggaaaacccaauaagguagaaagacaccuugccaaccaguuucucugcccugucucagugccugggucuccugcauggugccuguuccuuuuaucugggaccaucuugcaaugggcgcugcccacauuggugccaccugggaguccuguuagccaccaggagagcuagagaucugagcaugaagacuagccuggaagcucuuuaucugauuugcuguugucauuaacggccggucauaauaugacgagccugguugagcagcccuuccucugcugccuucggaguucucugucuuaugucuccuacuuccuucaguguuugcagucuucauuuuauauaacuacuauuuacuuaccaaaggcaaauccuacuuuuuuucagaccagggucucgcuguguagcccagguuagccuacuacugucaaaccaccuauuccaguucuccaagugcuggauugcagguuuguucugccacugcaggccuccgaucaggcagauuuaucugggacagaagcuauuugaggcaugggugguaauacaauucuuucuuuguccuuagugaacuauguuacagagacuugaaaaaaauucuuucacggcugauggaauguucucucuguguccuuguggcuguucucauguggaaucuguggucaaauggauaacauucuagcuguuugaaauuuuaugaaccugaaaaguugugcugagacaugccugguguguguguguguguauguguguguguguguguguguguguguguguguguguguguguguuuggguguauuguauauauacaugcauguguauguggacauuuauguguauguaugcaugugugugugugcaugcauguuuguguguguugggggggaguauuucucuuuuguaagcaaaagucugucuugucaguguugcagacuauaguggggcaguagccauacauuuggaggcuagcacuguuuggcugggcauaaguacccugucaaaauacagccauuucagaaugguugaaaaugggaugggguuuguugccaccuggcugaaaauuguaguggaaagcgggguggaaagcagccagagacaccaucauuuuguauuccauggaccccuugacucaaauaagguguaacagucuucaacauugucuuaguuaggguuuuacugcugugaacagacaccaugaccaaggcagugcuuauaaaggacaacauuuaacuggggcuggcuuacagguucagagguucaguccauuaucgucaaggcgggagcauggcagcauccaggcagguguggugcaggaggagcugagaguucuacaucuucaucugaaggcugcuaguggaagacugacuuccaggcagcuaggaugagggucuuaagcccacgcccacagugacacaccuacucuaacaaggcuacaucuauucuaauaaggccacaccuucuaauagugccacuccuugggccaagcauauaccaaccaucacaaacaucucaguaugaucuauuacucagauaauagauuagagggcguuagcuacugacaaaggcaggcguggagguauuuaaagauuauuauugaccuuggcaaaguaggauuggaaggcagaggcaccugagucucuguggguucaaaggcagccuggucuacauagcaaguuccaggcuagcccagugauagaaacauggugagacccugucuaaaaaacaaacaaaccaacaacaacgagccaccuacaguugguauguguuuuuacugguauauauuuuacuaucaacaugguaauguuguucuuuuccccgacaaaggcaauguaaggagaagggguuuauuucagcuuucaguucaagggugcaguccaucacagugggcagucaugaaguagcaggaaguaguuggucacaugacauccacaguaacagagaguggugaagccaugcugucacuccccccuccccccuuuucccuccauuauaguacagugucagccagggagggagccguccacaguggauggucaucccaccuaaguuaaagcacaggccugcuccuggugacucuagauucugccuaguagacagcaugaaccccacgguaaugagauccaaccacagguggaauagcuauuguggcuuugaagugguuacauugugcuguuugcagggcuggugggaugcuaaaggcuccuuaggagcacugcugcagcuccuugcgcuccuccucauggcagugggaguacagcaucguguccuggcaucgcugcuucccgagcauguccccaugucacagcacaaauaacugcagaugugagaacacucuugagccauggaugacugggauccucacucaaugaguaugaaccaucucauuuccucagagucugcucugacugggacaucgcagagugugacagacuguugcuauuagagacccacugugggacucagcucagugucgggugcuugcuuaccucacaucuacaaggcccuggauccauucccaguaucauacauacacacgugcagcccaagucaagacccaugugggcagcauugcuuuaaauuuuuaauuuuauguguauaaguguuuugccugcacauaugucuguguaccacuuguaugccuggugucuguagggaacaaaagagggcaucagaucuccuggagcuggaguauacaugauuaggagccaucacaagggugcuguaaauugaaccuagguccucuggaagagcagccagugcuuuuggccucugaggugucucucagagccugggaauccugugcuuuaagcauaguuuuuuuuccgugugugugugugugugugugugugugugugugugugugugugagagagagagagagagagagagagagaggugagcaugugaguauguguagguccaugcuugcacaggggccagcagaauaagacauccaguguuguacucuauuacugcucaucuuaggcccucgagauggggccuuucacugaaccuggagcuaggagaguggcuagcaagucccggcaauucucgugucuucuccccacaucagggauagguuuacggguuuaccuguggccaugacuuuuuuuuuuuuuuuuuuuuuuugcggcagagucucgguauguaaccccugcuggccuggaaaucucagacaucuuuccucuaucuuuuuacagagguguggggauuugaagucaagucccgacagcaucuuauuuuaaaaugagaaaacacaaccccacucucugaucaggagacaccugugugucucuuguccugaacacugacaauggugguaugagaacagcuucuagugccuguuguggagaggccggcuuuaacuggcuauggggcccugcucagucaccugggccagcuuuauaugagcguuggugucccugcccugggguccuaaauccucugggggcagaguggagacccugaccacaguuugguggugggcguauccugagauaaauaauccucuuucucucuuucuuucuggcagggcgggagcaguuucauggucugggcucccuguacugccgcggagcggccgcuaucauccuuacauacgaugugaaccacccacagagccuguuugagcuggaggacagauuccugggccugacagaaacagccaacaaugacugccuguuugccauuguggggaacaaaguggaccugaccucggagcgggacaccgagggcggggagaaggaaggaccggccucuggcaaggugggcagcugugucuccaccaagguacccaagcaggugcagccagaggaugcaguggcccuuuacaagaagauccugaaguacaagaugcuggaugagagggagaugccagcugcugagcagaugugcuucgagaccagugccaagacuggauacaauguggaccuccucuuugaaaccuuguuugaccuggugguaccuaugaucaugcggcagagggcugaggagucagaucagacuguggauauagccagcugcaaaacacccaaacagacuagauccggguguugugccuaauggcaggaggucugucuuggc

SEQ ID NO: 12140 - RNA, 29163 nt, Mus musculus
guuaaaaagguuucuguaaauauuuuauuuuccauauuuuagagucagaaagaagcauguaguaauaaaaauaauagagaauuauuuucuucacauccguucugcugcaaacugccagccccucuagcccagccccuuccagccagcucccaccaggucacguggcucucucugagcagccggugacccgacacccgucccauuauguacagauauguuacaaggcaaaaagaaagaucucaagaaaaaaaaaccacaagggcgguagcccaccugcuccaguguugcaggaccaugcgagaggagccagugcuguguguccaaacccugcuucauuuuugucuuuagguguggagcccucuugcagcucggucuaggggguggcaugcuccacaggcgggcaggagugggaggugaugucacugugcuuguacgaggccguauccagguccaggauuuucccguuuaccuccagagucaugcauccgcgguagaacgcagugacgggugcagaaaucaccgauacuucugagcagggggagggcaaacacugaaccaaaggagcuugauccugaccacacgaugcuccccacccuccauauagcugagggccagccuugcccacacucugcaggauguguguccccuuucuguuauuaucccaugggggcacagaucuuagaggcauaagacaucaucggcaucccuuaacccaucccuuaaccgcgaccccccacaccaggcaugcaugaauaucuuauauugugaguccccaugccuuugauucugauugguuaaaacuaaauaccuaccaggcggggcagagagucugcuguuugcuaaaacucaaguccugugcauaccugcuaccccuguuccagucccaccugugggccuguguaagcaagcaggaugcuguuggcugcucuugcuagcuucugguagaagugugcgaagggcaggcaguuacacugccagcuacuuaaagcuacagaugccugccaguauccagguaccucauuuugcaucgccugguaaccuucuccucuguguuugggcuccuggguucucagacacacucuucaauggaugacuuagagcuaugucugccagaugaaggacugaacugauaagacccccucacucuaacccuaguauagggcaaccugcauuuauaguuccugugagcagaacccugucucccagucagcaccacagccccuaugugaagccagucaggcagagugcuccuaccuggcaggccuccaacauaggugugcacagagccuugcagaugugucuuaaguguguccagucgcuccugcagcugggcagugcucacuucacucuggcccuuugugccauccacuucuaggguggccucacccucccgcagggagacagugaccguguguuccuggcugucgcacaccuugauuuccaucagugccagggcaacauccucaacugccaggaccaccaacugcaggggauagagaggcagaggaguuauagaggggucugccuauccugggcgaggcuggccccguaggcuagcuguccugucuuacuagucucuuuguacacuagucccuucuuagggugucugguaacccuugcucugaggaugucuaggaacccuugugcuuucuccuccccugggcuugguuucuuugaauguaaagcaggggacagccagaaggugacaggaggagauggcucagugguuagagcgcauacugcucuuauagaggacuugaguucucuucuaucauccauauggaucacaaccaucucugacaccgguuccaggggaucugcugcccucuccuggucuccacgggcacauggugcccauucaugccaugcaggccaaacacccauacaugcaaaaccuuuugcagucccuggaaaaccgagggcuugaauuacccuuucccagccugagcugacuucucaaaaaggauguaacaggauacagcuguagcgcugugguaccagcacugggaaagaucagacacacugcccucucuggggugaacagucuuugcuagcaagggccuuggucuguugaucacacaugcuaggggugggucgagaugcugggcagcaugaagccuggaccccuuggugguaugcaucauggaaauuaacccuguugcugguuaguauaaguagcaagcagggcucuacggccugggcagauggaaagagaaacccuccugucugacgcacaccccucuuaggaacaugggagagaggaagguuuuuccuuucucucucaauagccucguuuccuauaagcaaauaguuggagucggaggcuugauauaguugccuggcuugggggacacuggacauagucugcggugaagcagagcucugccugaggggcagcugacucuggaagaauauggaaaucuccuagugcuagugacaugaugugacucuuguauguacggcucccugugagacacuccaugcuuacggccccgcagaggcucacugccccaccagccaccuuagcccaugcuguacaguugugcccaugugacugcauggcaaccauguccccaaagccagaggggacaccuagcugugugcacucagaccugggucugggaaggagucuccagggcagggcaggguucaacaagucaauaucccagagagugggugggggcuggggaccuuuccuugcuacuugguaccagggaugaaugggugugucucagguuuucaccgaggucaaaggggguggagauggggugcucggugaucagcguguccuagucaaagcuggccccauucaauucuaccugcuucuugagcuucuuuguagagugguagucgacuagggccacagagauggggacgacaucgucgucccccaccagcgccagcagcacccccguguccguggcagggcggauccgagccacaacuuuaacuucccaggugguuuccgugccgacauccagcgauguucgggcugcaaugaaagcggcccaucacaaggcaauccaaguggcagagaggcgagagugaguggcagcccagaccggagcgaucacaggggacgacagcucugcacgcucugggagggcaccuccugguaagaaggcgaguggggagcaugcaaccagguuguaccccaagaccugccagugugucaacauaucugcugagugguacucggccagggccacagagagggggaugacaucguugucccucccaccagugcuagcagcacuccugagucagucaggugaaucugagcugcaacccuuauuuccucagccugcagaacagggucaagaacuccagcacuguauguagacuaucaacccgugggcacgggggaugccuaaguauggcugcuccucaccucgaaguguccucuggguaacaacccauccagggagcuacaagcccagcagaaagggccaucugccgccuccucauucccacgucucccccugcuguucucaaagcacuguccacagccucagccaaugcgcuagccucccuucugcuggcuccaggagacccuacagcaugcaaguuggcuggagaacuugaggucauacucgugggugacugagaacagaugcugugggaggcaucgcuccagcaggcccuauguauaucuguggucugggugccuuggcugagccuuccagagccucaugaacauauucccauauaacacaugugggugcuggcgcagcugcgugacgcaaguccugauuacaggaggccgcauaaaacccuuagucuugauauuuacaucuguaccucaccaacuccagaauagaggaagccacugugaaucaggguuguuggcagagacaggguccaccucacugcccucuguaguauacuagagggugcuaaagcuagcuugaucucuccacccaccacggucaaaucaaguccucuauucuguacuagaugacaucuacaggauuaauucucaauaguuugucgaguguaugaacacagauugaaaaaaaaaguaagaauaaaaacacuuuguccucacagaagaggccaaguguaucucaccugguaggcgccugacaagacaccagacccugccugucuggugcauucucucagccuggcgagucaccaggcauccuuacucucucucagaacuugagguugggcggcuccaaaugacccucaauggcuauuguacuuuaagaaauuaugggcucuugcauaaaggagccuacgagcugaguaccagaccugccugagccuccuuggucacgcccaggucugguggacagcguuuccaucacggcaggccccaugcauccccccuccucagccacaugccugagaagcacagcaggauacacuuugcaggcccuuucuguuuugucucccugugggccugagcacccgugcaggccccuuccaagggugauaaaggcugaccuccuuccugucuucaugcuauaucuucuuuccuccucuaaacuuauuucugauuuacaacccucaugaagucccuggccagcgaaggcuuggcacacuucugugcacaugucaugcguuuggacauguccaagguugacuguccacuucuaacuauuggaccgugucuccaucacuuucucuuccauggcuaacaugugagguccaggcagcuguccugggagcugggcuuugcuggcccugcugaggccugccccagccuguggguaaccaguucaucacugguacucacggagacaggaagcauuuaaauggaucuuauacuucagccuacagcugccuagcagucccaccacggccagccccagauagggguagggcggcacccacuuacuguaguugagccuguagguagcaaauccauuccccgggaagaaggagccccuuucugucacagagaagcacugcauuuuuguguuugccuugacugucuccuggauggcgcugucuuccccguucagccaguuccaacuccucaugcacccauccaggcgaggguuaaucuggaaagacaggugacugacuccugguggcuuccagagcuaggacacuauaauggcagauuagagcaaaagaggcuucgagccuagcacuacaggaucuacaggcagggcccucuggcuuaugugugugugugugugcaucuauauuguaaacacaacuuuagggaguuuuucacgagagcucuucaguuuucagaacauuucaggacaccuauauccaugcagggcaggggcacacguaacagugaggcagccaccugcucugucugucacugugggcagagggacaagguaccugccaccugacuguguaagucgggggcauuuuauugugauuguaccuugccucugccuuacucgggccgacaaagcauagguagagaagucagcccaggggaagggaugccagucccagcuuaaccacaugcuuacggugugcaaacuguuacaucaucaaaucaggccacccuuacgugucacagaucugcaacgguguguuggauguuacccccuugggacucucuuggugaccgagucacuaugagcuaccaagcagguuuccaucugcagcagguguugucaucccccaaacgaggguucugaccauggggcucagagacagaugaagaacaaaggccaggcauggcauaggacagaaagaagcagaacuuugaaaaauggcaaaaaaaaaaaaaaaaaaaaaaaaggccaaacauuagagcauacuagaaaucuagguauggcuagcaagcuaaaaugauagcaauccaaagcauuuauuauuccauuugucaaaauggcauguuuuaucuuuacugcaaaguaaauuuuuuuugguuguuaucaagcuagaagaaaacuuaaaugaguaucaugagagguggccagugauugaugcauaauacaucaauaguuacugcuguccaaugaacggcugccagcaggaagauucgguggaacccugcuauuguaagacuugggcucagccacagggcaaacaaaccccuguaggcccugccaagccugagcugcauccugccccgugucgggaauggacuuaccggcuggacgagcucacucuccuugaagggaaugccgcccacggugagauucaggugauagaggccccucuccagcugaaacagcuccccagcuaccgcgaucuucauuacagcaucuuuguugaccuugaugacaagguuacguuccagcucuuccacggagaucuggagggggucaggcggggugggagggaaucaaguggacggucacuucuguaaggccccagaguguaucaccuggaccaagugcaccagaccucagugccgggcaucccacguuaucuguguuuaaggagccugacccacgagaccaugcuggugucuacagggccaaggguaccugaccucaggggaaacaauguccaaguuauuuggucuaggaagucugaccucacaagaccacaccaugucaccuguguccaggaggagcuaaaccuuucucagacuguggccuggguuauccccacacccuucuuuccucagaggaagucacuacuguggcucuccccucacgaggucagggaucugaaaguggaggcaggaucauccugugaagaaggcuagucucgccaauaccuuuggcauuaaacaacacacggcuuuuuccagaaggaagucauagaaagguccuauugaugcuuauucugguuuaaaagaacuugagagucgugucugauggggcacaagccucacaagaaacuggagccuggcugucuauacagucccugcucuaagacaagcacaggguaccaaccacaguccaacuggucucggguaaagugagauaagaccugcucacucagucucucuucuaaggaagauguccuucacaccugagacccuggacacuguggacuggcacagagagcugcucucgguagcuuguguguccaugaggaaccuccaggcuacaaaggggaaccugaaggcagcagagugcugggucagagccagacugaaccuaaugccagcuccauguuugaacuguucucaacacacgugacacaaacacggugucagauaacagcccagcgaagccucacagagccaacagcugcagcccaggcccugcggccuacgccacagacuacacugucaagggcguuaugacccuagcuuuuguagaggcuugucaccaagcuaaaauucccugauuaaacaagcuugggucucucagcuuugacccccucaccaguacagcugcugugggaaggauaucaguauggguuggacacaggcuguguguccuaugucaguacuaagcugacauuugaaucgcauuugauucagcccugggucuucugcugucuaggcucuagaugaccagaaccagaaaaugaagcuccuggccaccucucacccagugucaugcagaugagaaauuuccacccaagagugacauugacucugggauccaggaauagccccucauugcagagaaucccaaucuggaagauuuuuaucccaaaguggaugaggcacuguuggcugugcccaaggugaucccagugugcacugugucuagauaguagaugcuguguuguuguuguucuucuucugaugagaagcgaguguuuacugugcucacuaccaaggugucagguaaaucccauacccaggacauggccccaccuuuuugcuuaccuggucugucggucuaccuggccagcacaggugacuguggcuaggugcccauaauggcccaagggacuaggacaauuauugcuaaagaagagcuaucacuuccugcacccgcccacagccuucacuggcuuccagauuucuauagcagaaaccccaauauuucuucagugcagucuaggccugaaugucaguucacucuggcucucucauuggugugucuaccuccaugguauacaugacuguggccuauguaaccuccugccucaacuuauaugacaucucugcuacuuacaagguucugaugcuuacugaagcagagcucauccucucagcccugagguacccaaccuuaaacaccucuggccucaccuccgcucagcccaugagcugucuacagaguggcaauacucaugcggcugcuguaguuagaagagcauauguaguuuuaaguuuucuaacccccuaacaauuuagugucuaggauggaguaauguugaauaaucaagcaaauuccucagaaacuuggcacauaggaaagauuugaagugaagauuccugugugggaacuuaaauuauauacgauauggugggggcguacuuaguaucugcccccaucuaucagaagggcagagugugcuaugaauggcuggucagggagcacuggaaggggcagaccuuggccuccugggccauucuauuauugagcuaugagugacggugugugagcugccaccuagacagaaccaugccacagugacugcucccagacagcugggagcuggguucuacuccaggguuguccccagggcuguguagagggacccccccccccaagcuucuuuuguuguggacccuuuccuccucugcugcagagacaccaauugcucaaugccaggaagaagaacacacagcacuuggugacuggagagacggcagggguccuuacuugucaacaaaguggaacauuuuuucuucauugcuaagaggaaaacucaugucuguuuuucuuccaagccuguuuuacugccuggaguauaggauguguuuccagugugugugugugugugugcauucgugcacgcaugugugcaccaccccagcucuggugggaacagccgucagagcugagggcagaagaauugccuaugagcagaugaacggaggagucuggccccaccagcucaggcccauggguguuuugaguugguuaucuauguccucugguaucuuacaaugcuuggccuuccucaagcaguuauuccaguaucuucugggccaaagcuucauguuuacgugauauagagcccugaacggcauguguguaugugcgcgugcgcauauguugcauauccugguaugaacacaucauaccuugggucuacaccagcgggccagguggcugagaguagggaguugcuauggagauuucaucgacauaucucccuuucugaguaagucacacucagccaaugaagcagaggcucuggacuaacuagagcaggagccccgcccaugggucacacccauccccaaaugcuagggauagccuuggccuuccacuuacaguuugccacaugccgugguugaugguuggcccgcugcuggugaugcgcccaacgccauuguaccgaagcugcagcucaagccgcccagcucuuaggcccaggacaauccaggugcugucugaacggccuccagcgaagaagaggacuccuucagggucaaaagugcggaagucaaauucagccagcagccuggaaacagacccaggagacaaacugaggcccaaggcagauggugcagggcugcuugggcccugagcccagguagaguuuggccccuguggugcuuuccacauggggagcugguucucucagagguggagcugagguccuggaucagcucucuuaccugggcucugcugucccgugugccucgcuucucaccugguaggcugaagccucuugaagcguagucuaaucacgggggucccgcugaacaugcggcccagguacaaggacuucacgcucuuggccaugcugaagggcacacaugguaagauguccugccaugagauaggaugguguugggggguggggaugcccuguggaugccuuucaaguaaccuuugagguccuaggucacauuggaugucuagaaggucuccucugaccuucuagaaucccaaggcuagcccgcucccagaaaucacagaguccauaugacccagcucaugucggugccuccaggcagggaccaggguucugauuucuuccuuccauuaucacccuuuugucucaucuauucuuauuugcuacuggagcuuaaauuaugaaaugugacaagcucacagaggaacacagggaauaauaaaaucauuuuuuaguauacuauuaaaaagcgaacagaacacgaagaccuuggagucuucccugcuuucugcuguaggcuuucccacugaccagagcgaggauggaauuaaagcaggcugagcuggcuuccaggagccugagggacacaauggcccugaacugccacacugagcuuaacgauuuggacuucaggcucauaguugaaaaaugguucuccagcuucauaggucucucugacuugcagaguuaucaugguaccugguuacccagaguccuugcuccuguuguucagaaaaugccaucaaugaacaacugcccugcaguuuacuugauauagagcccugaacaguguguguguguguguguguguguguaugcauaugaugcuuauccugguaugaacacaucacaccuuggaucuacaccagugggccagguggcugagaguggggaguugcuauggaaauuucaucaacaaaacaaaagaggcucugcuagcugugugguccuaggagcuaguaggaguuuucagucaaccaagucucuagaaacuuucuucccauaacccauuaauaacaaaggguccuauucaaagccaggcacugggggcuucacgaggccaucuaguggacacuacggucaccuaccucacaaguauccaugucuggggauaguuuuaggcccccucgcccaucacaguggcagguauagcugccuggggaguugacacaggucugcucacagcgauccugcuggcacucguccacaucugucgacaaagggacucacaguaggcacgggaaggcgccaaacacucggugcaacccccugacuccuccuagagacucuguagacaucacuguuuauccuguuaucauggaggccuaucucuuagggcccuacuuucuagagagaaaugaacugaagaugucugaggacugugcucagacugaccagcccagacauggagggaccaagguuguggagagugguacagagccaggauccccacaaguucuuagcuccgugcucccuuccuugagggcucagcuuuucuccagagcuccuguagggaaucuuuuggagucuccugcaacuccuagacaggagugacuguggagggagucucugcccuugggacauggugaaccuccaaagugggaggagagcagaggcccacauuacucuccauccacugugggugcaacacaagucuaccaaggucuucccuuugucuacugcaugcuagagaaggcugacaacacaugggugugugcucauuugaguucauaugggaacacacacacacucaugacagcauggucugugugcauacaugcauggauacaauagggccagauaaggggaugagacagagggcucacuuuagggguccucuucauugaagcuacacagacucuccuaggagguucugacauuuucccaacccuccuguguacaaagacuuccuggaacacuggaccaaugauugccaccaaugaagcaagguggucuacguucaggcagugaccaacauguguccuaggcuaagcaucaaagaaggaaguacccuggguaccuuggcaggucuucuccuuggagcuguauguauaucccucaucgcagaggcaagaguaggagccuggcaaguucuugcaucgcgcguccccacaggugucugagucugugcauucaucgauaucugcaagcaaaggcagccaggcuaaggcaguacaggucggucuuggacagcugcagcagccacuggggcaggaggguagagaacgggaggaaggcacgaugccuucaccacgggugucaagugauagugagcccaaggaccacaugcugcucauccacauuguguacacuguagacgucauugcucaggauucacaaugcaaggcagguguccucaaccugcuacuaaagugugggagcuaugagccuuggccaaggccagggaugagagccacaaugagaggaccucuguuccuugaauggagaggacaugggaggggaggccuauaccuccccagaugcaucuccuguauauuacacauaguuacgaggacacagugauugacaguucuccuacaaucacaccuccuaagaauaaucuuugggauggucagaggugaacucuguggaagauaaaaauaaaaccuuucccccuuucccacguuggguuugggaaaucgucauuugucugaugaugucuguguucagauccugaguuccucucacacccaggcauucaucuggaacacccacaaagguugcugugcacugguccuggugagccucagugacucagauacucugggucuaucuguguuggacugucauuccucuagauccuaaaucaauacaggguugaaacauggacaacugagaugguuuuucugggugaucuggacugaauggaaaugggaccacacaguggggaggucccaucugcuucuguguucuugggaguagaguaaggggagcugggagguauggcagaugcacagagguacuggggacugucaccccucgaggucucugcagucacaugcaggggucuaggccuugugacuacacaggcugucuguagguucugugggugggaaggugccuuggaagcacaaguguggaugggcaucuccagcucuugcccuugcucucagauguagggaaucgcccaugaugcuggacuggaccaucuccaaaggacacucaucccaccaccccuccccaggauaggaagucaggcgagguaucacugcacagccagggccuuaccuuggcaggucuggccgucugaugcaagcgagaagccacuauggcaggcacauuggaagcuuccugguuuguuguggcagaccuggcugcagcccccauucuucuggacacacucauugacaucuggacaugaagaaagagugaggggcuccuacccgggcacuucccugcuggccucaugguaaauacaugaacugcugcugcugguggggaaagccauagacuugguucuagaggucccuaggugcacaaggggacagggugaaggacaaaauggacccaccaaucagugcccagcagucaugagaccaaugcacagccuagucuagcacccugaacagaucuauccagacgaccuguggacaccgcagggcuguguugagugagaagcuuggcagacucugccaucuuguuugcagcuuuaccuaauaccucacaccugcuccagaguagaucaaggugggacccaucagcuggggugcuaagagccaugugcuauuuccuucacuccaauccugguucccaaagagcucccuggagccucaacucuugaggagccugcagcucuagaggaugaaccucagggcugcugaauucaggagguucucaggcagagcaccagcccacccuggaccugcaaaggggucccaagagggaugcugauacagaaaagacuguagggaugguugagcucccagucuuggguagagggugaggaguagguggggcagagagagggcaagguguggacucaccuuugucacagagccggccuccccagccaucugugcacacgcagaagaaguugcccaugaggucuuggcagauaugaguacccuucuuaucacaaggguuuggggugcacuggucaggcaagucugaguuggagaauacaaaaacgaaaaccacucagaauaucucugaaagccucaccgucucauauagcuggggguggucagagccugggggggggcagugaagcucccagggguuccaaaaaaggcugagcugugauggaggguccuaccuugggacagaaacaaauaugaggaacuuuuaaagcccugggaucgguuccagcaccaccacccagaucuacugagcuaugcaaagagagacugcuggcuccugccucccaggaaaugggucuucaagauccccgagaaggacuugggcacauucucuccacagcacugguggagcccacugccaaacacacaggaucucagcacuggggcaucacgucaggcgugcaguggucagacaaacaagacacaggggugacugagccauagagcgucagucuuuagcuucuagcaugcaguuaaaagaucuuucaaugucaccgcccuccacagaguaccuuaggaacauggcugagaccuccggacacagccugcaccaugccuugcguggaggcaggaaaacucugcgugugcuucaaccccaagguugggaagagagagccauuauuauauccuguucucaaagaacccuuucagagguugaacagaugugggcaugacccagaggauaggaacccugggcccuucacucugcuccauuugaaggagucuacagucugccuggaugggguggguggucuccugucuaccaacaagcuagaucauucuaaaguagcgguucucaaccucccuaauguugugacccucuaauacaguuccucauguuguggugaccccccuccccaaccauaacauuauuuucauugcuacuuuauaacuguaauuuugcuguguugugaauaugaguacuuagguuuuccgaugguuuuaggugaccccugugagagcaucauccaaccucaaaggggucauaaccuacaaguugagaacugcuguucuugagggucuagauacauggggguaucagcuccuaucacucuuacaaggggugccacuucuuagcccuaaucaguccagacuagucacccacgugaacuggcauucuuucacccagagaucuuaugccacuugguaagcaucuucaugcugcccgauuccuucuccuugauguauguaugccuaucuguugccagaccaaagacuggcucuaaaguuucacuaguagaagauauaaaauagggcugccuccagacggcacaugcugagcucugacuggaugaagguaaccaaccccauuucccuccugucugucuucaagagugugguuagcaucagcuggccacccaagcccccaucgcaggagcugcauccaagggcaguagucacacgugauccagcacuccuggagcauagcuguacuuguaaauuuuuuugccaucagcucaugccucacacaggcaggugaugcuacacucuaaggguaucuaacaggaaguuccgggcugggugggcccucuguggugcacgaaaagcugagacccgagagcugaggaccaauaggaagccugagcuguccccagagccuaggaccaauaggaagccugagcugucccucucugaggaggcagccuugagaugcuuccuuggucuuccucugcuuucgguaguaggcagccauuuugagagucaugacaauucacaucucugacuuugauucuuggugucggcucuugggcaucccuagccuaucugcugccgacauaggucugaagccagcauuuguuccuucuugaguuacagggagcaguuucgggccaagccagagggggauuggaaacacuggccacugucuccaggaggucauccuagcagggugcuagaaggucuucuaggucacccacaccauguuugcuccauuccugggggccucuccacaggugccucccacaccuaaacucuagacagagaggguaaucuugcugccuggcagggacgggggcacaccaggcguaagauaaggcaggggccaaccucuggauuucccagaugcaacgcaggagcccauccaggcuuuucaggucagcuucauuccuggcagccuccacuuguccugagccagcugggcugggugccgagcccauggcaggcaugggaagcaagucuaggcuucucagggaagcugugcgaucugauuccccuccccccuccccccauggcccuuccacguuuacauccaaagucugcuggguuugcacaaauuacagccaacagugugccugugagucuucaacgacuuuugauuucuucagagugguuguuggaagauuauuauaaaaugucauuuuuccuuaagcaaguguuggcuggauaaagucagaguggccuguaagugaggggucaggacuggagggccuuguuguucuacaacugcuguggacuuguggaagcccaccugaggccaagacgugguguuuggcuaacucaaguaucugguuggaggccuaaauuuauuucuaaaguuuacacugguaaauuuggcacaaggguugguuaacuuggccaagagagccacaucuacccauugcaaaaucuguccuuaggccgagggaugacgcugugccaacuuccaauggaguaauauuauuuuuaagagagucccaacacagagccaauaccaaaaccuuugucccucugucccuagagaaauaccacccacgacaugucauuucuuuuccuguugggaauuuaccaagucccauguuugacccuuggcaggugcccagaguuucuccuuagacacauuccagaaaggugaaagaguggacacuguuuugcaggccuugagggagcccccuuagcuuuccacaggcaagcuauucuuacguugucaguuuacccugggucuuuuuuguggcuguagguggagugugaagugugaacuggcucacuagguggcaaguuaggaccuggguacccauccuguccaauccagguccuauguugugggcccagaaaggagcccagaccccuaggaaaucccaguggcuugacucaccaaccacugcuugauguugucugucagaggaucacauuggacaugacagggagccaggaauggcuugugagaaaggaauggaaugggagccaaugcucuuccuggcaccaagugggcagaguccaugcuuagacuauggcuucucucugucacucuaguugcuguuggcauggugaccagcucccauggggugagguaauggguuuccagaagaccugcucaggccaggguuuguuuagggcuaggucugagcucucuagaaauugccagaaugauggccugcaaaaacuuuugcuuuaauuuuuaacagaaaauggguaaccagagaacucaggcuaugacaugccaugggcagcagggugaggagccagguacaaagagaagcagccugcagagcugguaggcuuggccuuggccuuaucuucccaugccucagcaagaggauaugcgggucauugggcacuuuugcacagccuucaggaggggcacagacaaugacagcugaggugggcacccaugggaccugugacgagcagagccaggcaggaggcaguuuuguguuagcccuaauccagcaaggcaucuggcaaaugaauuuaacauaucugucaccagcagacacagagguuuucuucucuguucagcucagggacaggcucuggaaguacacgcccauucuccucuuccaggccaccuaccaccuaaggagcagaacaucaugugccccucccaccggaaggugucacugcaauccaaaacaucuuaagaggguucgaagccauaauucuagccaccaaccaaagcaauagaauaaucccucagagcacugggggcaaaggugaaugccuggggacaauaauuucauauguaccaacaaauuagaaaguauaaggaaagaaaugaucguccuuggguggaggaaggguuguggggcgggcuuacugggagaagggccgugagcccgauguaaagugcauaaguaaauaaauaaacucauuaauuaaaaaaauugucucugacccuuucuuaggaaccagaacuguggacagaagcauaggacaucauucuagcuugugauaacaggaacaaauccccaacgcuggucaaucaacuugcuuuaagcugagccaaagaagcugacaucugacaggagaugugacuguacuugccugggaagggacuccuaucagggugacuaaggacagggugacaccggugugcaaaagccaugucugcauuuccgggugcaggcagagagcugaaagaggguuuugcccacaugauguguaguaggggacauaccucacaccccacggacuauuuaacucucuauaauguguacauguauuguucauuagaaacaaaaccgagaugcacuuuguuaaaaagaaaguuaaaagggcaagaagcugacuggggagggucggacagcuucucccucagcagccuuaccccuggcuacccagcacaugcuucaggugaagcaggagggcacacuuacucugaacacauuuggcgaaaucuggguuuuuuucuucaggccugccauauuuucucaugcacucugcaagaaacagacaacacagucacucuucauuccugggguggagcaguuauccaaauuggggccagaugacaguuucuuuucaugcggacaccguggaucuccagugagugcaugccaaucugucaguacggagugccuggcagggacagcaggaagguguaccagugugaccgaacaccgggcccagaccggugagugcuggaaucucccaccauauagaccagcaaaagcuacagugcaagugugauuagggccaaagcugagcuucaagaucacgaugguucaggcagaacuaaggguacuguucuuagucugcaggcagaaacacucuuaaggcaccuuaagccuggagggcacuagaucuggcacacaaguguguucuucaaggggagccaggagauugacauuggaacagauacaacacgugauggccgugugugcucagccacucuaucugguccuucaguaggccacaugugggaaggcagcauggacaacauaagcacaguuaggaugcauguguagguuaacagagagauggcccaaggcucuugggcugguguggggcuucagaggacacccugaguaaauguguauugugacaugggcacaauucgcugaagacuacaacgccaacugacccaugggaaauugguaaagccauuacccccacgggccaggaucaagaggaauggcaaagcuuucuugggauucugaaaacgaguguuuacaaaugauggaucaguguguauaaagacuagcgacuguggucucuuccucucaugucuacagccugauaucuacagagacuuccuacugagauuagcuagcccuuccccugcguuuuagcuaauaaauagauugaagugcugggucauagucuaugucuuggagaaccccaugaaucccagcuugacuguauaugucugucauuucuuuauucucuugucuccucuagccaauauugugguacccaagccuggagagucacagcaggcuagucacuggucuccugugcuguugccagauaggauuuauaagcaggugccuguggaacagaaggucaguaucuuucccaaaugugugguaaaaacuccaaaguccaagaauauacaguucuuacaagcaauauagauccaaaguacuucagguguucaccagacaaacagugcucagaggggaauauagggcuucuuaaagaagcaaggugacuauccucuaaacuaggacccuaaucuuuuuuuuugucucuccuauaaaagcauauuggagcaggguagugcuaguauaugccuuuaauuccagcagucuagaggcagaggcagguggauuguugaguuugaggccagccuggucuacagaaugaguuccaggacagccagggcuacacagagaaaccacagagggaaauaaacaaacaaaagaacuuaugauauuuuccuugucacugugugcuuguuccaguggcugagaguuauguguguguuccuguucaucaaacuauguacaaagccuucuguaaagcucuaaguuuuaacugauaauagagcaaauguugauaaacacacaacauacaagcaaaacuauuuuuuuuuuuggugugugugugugggguccucaauaaucucagaaguacaaaguccugacaccaguaaguuggagagcacucaauuagccauacuuccagaugugggcagggccugcgaucaacugaagauaucugcaaaacagcagcauuagucugaggcucaggcaacucagaauaaaaugaugguauaaaaaacacauucauguauaauacucacacaugaguauuguugacagcucuaaucucacagcucccuucuucuagaaguaacaugguaaugggauuuccccagcaugaaauauguguguaugacaacgaagcuacuauaguaacuuuaacucaccuugauaucguggauagaaauacuccuguggaaagagaagaaaggacacaguuaaccagcacagcaugaggccuuugaaaagggcuauuacuggcucaucaagcccggagacaggaacccagaagcacgaaucuugcacuguggcucccucaaagguagggcuuggaagccacuguccagaaaggaugucacggaaagaagcagaggaaccagaggccucugcugacucagccucugcaagaugacugcaaagcaugacuguguagucaccuucaggaggaggcaaaucggugucaccuagaccuaaauagagggugacucuccacaugucuucugggaaaaugcuuguaggauagacacaguccagguaggagcccaguuucaguccaaggagagagaguucuugucucaggguuuccauugcugugauaaaacaccaugaccaaaagcaaguugggaaggaaagggauuuuuuggcuuacacgccauggacaggaacucaaacaggacaggaaccugaggcagaagcugaugcagaggcuacggugggguguuugcuaauuugcuucuucuggcuugcucaaccuacuuucguacagcacccagaaccuccagcccagggguggcaccaccuacaaugggcugggcccuccaucuuggaucacuaauuaagaaaacgugcuacaggcucgucuacagcccugcuuauggaggcguuuucuuaauugagguucucuccucucagauggcguuagugugugucaacuugacauaaaaccccuugucaaacugacacacacacaucacuuuaagucccaacccuuucucucucauucauccccaugaucucacauuaaaaacauaaauaacuuuaaaaagucccacaguaguuauaaauucaaagauauuacaaguucagucccuuuaaaauacccagacucuucaaaauccaaaaauguuugaaauuuuuuuucagcugugggcuucuccuaggggcuuaggucacuucucuggcucugcccuuugcagcacuuacagauuagauugucuaggcuccagcuggcugcacuccgccgaugcugcuguucuugguggucaucccaugguacugaucucccaaaugcugggucucugcagugggcugcauuaucuccaauagccucuccugugcucucuucagaaacgccaacucuacuacacauugucaagccucagcugcucuccaugucccugucacacauucaacaccagcgccacccauugccucuuacacuaccgaggucuccugccagcacaaggcacagcucuggaacagagcuucuguguguugacucucaggaaacacuuuccagaagauuucaccucagugaugcuggucucugcucaaucacuguuaauuucucagcaccagcugaccagcaucaagagaguaucccagcaaagcaaagguuucacaucaguaucucuucagcuaaccagaaccacagaaucuaauucaaaauaacaagaggccccaguggagccuuuaaccuucccccugaaacuucacaaguugucuccacugugcucaacaguaugaucuuccaagcucccacagaacagcucacugagccucaacacucaauggcuuuucuagcccaaaguccuuccacacuccuccccaaaacacacagucaggucugucaaugcaauaucccacuauccugguaccaauuugucuuagucaggguuucugucgcugugaugaaaagccaugaccaaaagcaacuuggggaggaaagaguuuauuuggcuuacacuucuacaucauaaucuaccauugaaggaaacuaggaccgagacucaaacagggcaggagcuggaggcaggaacuaacguggaggccauggaaggaugcugcuuacuggcuugcuccuugugccuuacucugccugcuuucuuauagaacucagggugacuggcugagcccucccauaucaaucacuaauuaagaaaaggcccuacaagcuugccagaucuuauggaggcauuuucuuaauugagggucccuucucugagaugauucuagcugagucaaguugacauagaacuaucuagcacaguucucuucauccucagaugccccccccccagucauugauuuucauacaauaucuuggaaaaacacauuuucuagucgaggcacaaaucuguucacaagagcucuuuccugucucuguauccccacacuguacaguguauacaagcccucuggcuauuccaggccagugaccagaugaguagaggccuguucagggaugauauacgcaacaggcagccaaacaggccaaugcugcagacucccagcagagcgcccaccucaccugcaaugugacagacgucccuguuuguguucucucaccucucucucacuagugaggggcuacgugggugagagcagagguaacaggggcggagcaugugggaggaagguccccaugacuagggggugauggugugcuuuucuacaguuuuagaaagaauaucuggaaggaacuuagaugaccaaaugcccuucauguuacagagucaaguguggggaugcagccagcgggcgugagguggaguucguguguuugguguuuacaugguuagggaagagccuuucauagccacacacauggaaaggucaaagguaaaagcaucaaccacacuccaguaguacugcuguaggucugucuugaggccagcacaagccaacuugacuccuggaaggauguagcaauucuaacacccagcucagaaagacccagugucuuuugcagcugccugagagugacagaucagaacugaucucccugucccccugcccaggaccaggcaggauccugcccuuggauuccagcuaucuaucaauccuucuuccaggccuccuuggaggaacucaccagccgggcugaagcuggauagcuuccauggcugccugaucagacuacaucugaaggcagcucaugucccaaaagacaaaacccacacaagaggacaaugcuggaugcacgcauuaucaagacggagaaacaucugagcccaaagcagggugcagguaaacugacaucauuuccugugauugcaaacgggauggcccaacugccagcccaugccacacaacugggaagguucuagauuauucugcacaguaaacugcggcugccaccugcagaacaccauucucaccugugucuguaaguccucucagacucuuagaggccaagacaucucugccuagcgaaaugaggcaguggaauggcuuuuuuuguagucgggggagcauguuacuagcauccucaguuuugacuucucaucauacaugacaagcccaccacaaacucucuuccacaggcagcaucgggcuuacagaaugcucacacccgugccucugcccuauggcugcugacucucauaggccauggguaccuagcuguuugcugcuucauagacaggcuuuguggagugcacacucccagggaacucugagcgucagaugcucagggugguggaaacacauguucuaccucaccagcucugcacacagagcguuacaguugaagauguacacaguacugcucaucugaguuuggggaacauucuaagcacagacaagaagacauaguuucgagggagagcuuucaaauucuggggacaccuccgcaagguauuucaccuaagaugucccuucucugccaagaguccaaauuccaacucucaggucucuuuuccugagaagacaccccuuucuuauuuuucccuccccacacugggccucguuccucuugucuaguauucuaaaaggaaaugggaugggagguguucuaccugcccuggcacuggccuuccccgagcuguccuuggagaacccaccaugucaggacaaauguccuuaguggguagacaugguuuaaacauggucacccaggucccagacccuuagaacuaacagugccccaaagucccaugagaguacagcaguagcagcagagaagggucuggggggcaggcagggagaaugaauuagagccaccacugaaagcugagacacagucagggagggagggggcggaggggggucucucauucagcuuccggaguauuaauccccgcagcagccagccaacccacuaugaaucuugcaucuuaaaauuuaaaaagaaggugagaaucagcaaccaggccugaggucuuccuuccuguaccaaaguauggggcagaggcuccagcugggauuaacuucuugauuaggaaccucuagaggccagcauccuaagcuggggagcagccuuaaggcuuagguauauuacugaagagucugcagaaaggaucacuuggggcagaguuacaaccucagggccucucuggaauuagcaacugggacagggaacccagccagugagaaggaagugcccggaagggacaguaacaauaaaaagggaaaccagauaacagagaggcugugguggagagaagggacagagagauuagacguggccagggcugccaccacaggggagcugccaccgccacugaggaaugcggguggaggcacacaguagcugucuggauccugcauuuccuccccagagaaagucaggaagaagcuaccaguauccgcccacuggagggcucagaucuggccccuuuuuuccuaaugucagaagaaaugcuaacuaaacagagccagacucuucccagacaaagugagaaaacaaaacaaaacaaaacaaaacaaccaugugguucaucaugugggagucggccuguuuccagcgaucuaggcccacccaguauggagggcaggaccacacugucauccccucccugggggcccuggaaauagcagauauaaggagcaggugugcaucagcuacaguuggccaggauaccacucggagccacaggaggcuggcuggucuacuccagcacgguauguccacaacaucagggaacacacaacaggguuuuaacaaguacugagagcuuucacuaaaaccacacugacuccucauucagacccacaggagacaagaggacuuggauggaagccuggcaccucuauuugcauuaugagucugucacuugcuuuuuuuuuuuuuuuuuuuuugcaauggaggcaugcuaaucccucgggcaccggcuacauaagccuggagccgcauacccaucucgucccccugcaggguugaccacacagauaagcagauaggaaggauguguuaacauucugucuugucccagauccccaagggaaguuaagggucucgagggacaacagagucuuagagaucacugagaacuguuauuaugaaggaaccugcacuccugaggacgcccuuguccccucgaggaauaaggacuccuucuaaucacuuuguaguaccaguacugaggcagcauuagccggaccacacuugacacgcccugcucagcucagcauaucucagacacugugcccaauccgucuauuuaaauuuaaagcucacauccacgucccaaaggcagcccugaggugaggccacugggccucuuguuccuuuccucggugugcacugacucauuauaucucugccuucugcuucucacuacuucuagucucuauggauagaguuacccaggcagcacagccuggaucuuuggcauucccagacgugguccuuuuacccuaaaauuucacucacagaucagcccaguaaggauucccgaggaccauugugagaaucugcucugguaggugaucugcagaccucagcuucucauugucacaaagaguggggcagguaaaccgaagccacgccucuugucaagaccaucucaugggccucaucuuacaaugagcuacauuucaaggccaggaaagcugaccuagcauuuucacaggaagguuacaucucuucccacucuuccuucugaggcuaugaaggugacuggcgcuuguauauccacuggcgcgggucuuaggucuccccagggguauggaguaggggaggcuccagccaugggucccugcagaggaucacggggacuccagagcacagcuugguacuaccucuuccugaggcuugcccgguaucuguggcgccaggagaaaagcgacuagcagccagaucaaggugcuagcagcuaggaaagagcuuugauuuggaacucugcaaggugacgugaggugcgugcggacuggaugccgggguuaacaguuuccauacugcaggcaagaggcacaggucagguauccaagcuggcucaugagaggaaaguccacguguuaggguguagggguuacagagggacaguuuuagauagcgcugaugggaagagguguacgccaagcccugaaggagacaggcucugacaggaccagaggggucuguccuuuggagcauuauagucaggaguuucacccaaaagcugacagaaaagggaaacccucccauggccgaagagaaguuauuuggaggagguggggguccugaggacauuacucucuuucaugucuucauuucagaccuuugcaaauaagaucauaauuaaaacauacaagcaauuaaaaccagagggacuugacucuaacuaagaaaagcaguucccuguccaggcagucaggagggccagcuugggccugucugcccuggcaggcaggcugcagaggggcgggacuccaccgcugggugguggccuugcugcucucucucaacucuugucaccacaagcccuguccacacugaauggcaggaagcuucaugggaggguggaguuguaacacacagaaccagucaccuaagcccacagcccaggugaccaaggacugggacuuacccuagaaugccgauggcagaacucauugggucgagagcaaucaucaaaacagagaagcagcagcaaggguagaaaaagaucagccaucugccccauccugcuguagaugccuggggcagcaccauggugaggggagggugggagguggggugggggaggggggagcagggguggggcacagcuugucaccugaucuuggcuuccacacuggguaacagugccaaagcagcuauggugacacucaacagcuguagcaccgcuaucaggaaagcagcuuugacagggauuguccagucagccgauuagacacaagucaaagcaaaggccccaauggcucacacagcgccauccuaacaucaugugauccuuacuucaccccagaagaauucuuugaagggaaaaugccagcggaacccaacauugugaaaccauaccgauuuggcagguguugggggggggaguggggggggggcucugcaucacuacggagacccgugggccaguccagaucucaaucaaccucacgcaugcccuacgcugggguguguuccccucaugaauccacucagcccccacgcgcaccuucuggggagaguccugugcauacauaggcugcuggcugcaguuggcuguacgccugcuccauuccccaaggacauuauuaauagaaguuuguccugggccagcacagcccuugcagaggcaggugccggcccucuuccucacguugcuccccacccgcccguaugcauguucuuagcacaauuccagccaucguauuuuuggaccugcugcagcaagcaauuccagcuuugagaucuuucaauuccucuuucaggaaaacccugggucccuccggaggaagaccaaagaggagccccaccccucaccuccaauccaauaaagggacuggcagucuuaggaagccuuugaguuucaaaucacugcggauuuuucccacggguacuuucuuuucgaggguaggggaagauuuaguuucagagucuacugaagggaucucaguggagcccacucaaggauacgcuuucuacuccugaagaggagaggacuugugggucaacugagaaacuugggcucaagaauggagaagugcaagggggugcgaagaaggcucagugucuaagaguucuggggugcacgugguggugcgguccacacaaggauccuuacaucuccagaaaggauguuugggauucgacaguccccgggucuccuggacccucacagggugggagucggaacuugcggcccccaaaaguauggguucugggacgcccaggacccaccccgcgaccccuggcgcacgcucaccgucucggggucguucucgaacaccucucuggccuccucuuugcugcacaccuccuccacgcacucccguuccagguggcccugcuuggccuccucgaagacuugguaggcgcggcgcugccugggccgcagaaacugcgccgccucacgcgcccgcaacagcacagcugcagaaagaaggguguacggucaaccuacacccacucggggcuggaauguagggggucugggaugcuggggaucguaaugccugugugucugggaugcuccggguccgugaugccuagagcucagagguccggggacaggaugccagggugucugggguacccggcaccaggaugcugcgccgggguacaggccuggagccccacaccacgggguaguggguuugggggaccccugcgguacucacugugagaagacucggaagccagcaggagcagcagaagcgcagugcccagggcggcggcgggcccgggcgguggcggcauggcgaggccggugccggggagccuagcagccgggagcgugcggucagagcacccgggaggcugaagcgaggcgcggacgccgcgagacacgggcuccggucauccuggcuaagcgacggugaaggucacaucccugcggcggcagcgccgcacccggcgcucgcugcgguucugggccgugaaggaggcagcgggu

SEQ ID NO: 12141 - RNA, 56944 nt, Mus musculus
gcagaaauaauguucaguuuuaacaagagaaagaaaaaaaaaaaaaaccacuaugauacacggucuccaagaaaaugaguuugugcuaaauucauucccuagcccucuuugccaaaugaugucuucuuucagcauaaaaaccauucauaauauuuugacaguuacauguguacagagagaaacaacgauaagaacucuuaugacaaugacccaaaccacagcugccaaaacugcauuuaaagaagcagcccuaaccccuacagaugaaaucauacugaacagguuuguauucagcagacccagaaaaaaaagaccaaccaaccaaccaaacaaacaaacaaaaaacaaaaacaaacccucuaaggcuugagugguguggguuugaauaagagaccaagguaccaaagcaaccagcagguggcagaauugaguugccaaguugaccccaaccaaagagaucguuuucuguuuccugagggauggguggaguuugugaaggaaaaacuauaggaagccaagcucagggacagacccaacuggguaacagagaccaacagggaaggggaggauauuuacaggagaggaauaugaggaguagguuggggaagauagacaagacaucugaauguacagggucuaggguuuggguuucuguccaguucuacccucuggcuaaccucauccucucacucucuccuccgaggaaacaaucaagugugcgagcuuggcucucugcccucaggaccucagucuucuccugcuguucccaaugcaucgggagauagaaggcuuggcugggaggucuggggcacaauccaggagacagaggucauggggggcagggggaagaccagcucauggcccuuuacccccugucucccuccucugcgcuggacaccugcucucuuuucacacgcccaggauaaaaaugaagcagcagcaauuuuuuauugagggaaaccuaaacugaaaauagguuuaaaacauaauuuaaaaaaauaaaacagcaaaaguagcaaaaaaauauaugaccuuuuaaaaaacauuuuccuuuuuuuuuucuuucuguucguuuguuuuuaauauauagcaacggaugcuacccugggcgucucccccauggguaaaucucuaguaacgacccuuuuuaaaaagacauguaaauauauacucaagauuuauacacuuuguguuuuucuucauagcuauguacagagccccaagucuagggcucagcccaagggcacaucacggcucccagucucugccucccugucuucugguaccaggcagguauuuggucagcaaagcaaauuaguauuggaauuaagaagcuacugguaccauccaucuggagcagagguugccuucgguuaaggccuaaacagaaaccucacggcuuccaggagccccaaggccccugccgccagaacagaaggggcugaugggucaacaggaaugccccggaugcuccacuugcuuccgcucugcacaccuccaagcagugccaggcagcggggcgggucuugguccaacaccugggaaggaggaugcggccgucggcaagcaccugccucuuggcuccucucucacacagcaggcuaagaagagggagaagaggggucuugggggugauggagggggaaggccacaacacaggaaggccucagucaggcacuggcucuugccagcggcaaaggaggaggagaaaggcaguguguccaacaaggggauugugggugaggggcacgggugacgacggaaugggagaaaacuggggacaggguugguagucagcgccguuugaguccacuguuggcaagcuggguggggugucgaggcagacagggcuccucagguaacggcucaugagagaagacagaguccuccccugaggagcagguggagcuccgugugucgggaaagcugggugaguacugguccagcgguauggacagguccagauacuccugugacagaaagggaucgguggguggcacccaaaccuucccaggagccuaugugacagaggcccaaguuccaaccccgggggacagcccuaccugguuggaggucaaggccacaaugcgguccaggucuuccaccaacugcuugaacguaggucucugagagggcacugcaugccagcagucccgcaucaucauguaccugaagcaggauggugagguuagagagagaggaaggaccagggcagagcuggaccagagggcuuggggagggauggacagggaggccacuucucccaaagagaccuuucaaccccugcccaccaugcuccugcuuccuucagagccaggcuugagaccucaggaaccucgaauaagccaccaucaccugaggaagcugucccaacauccaacccagcuugccagugguggauccaaacagugccgacuacuaaccccccauccuuccccucuagccuaugcuuacagcucauugguacaguuacugggcuuguccauucgaugacccuccuucagcagcuugaaaaguuccuccacaggcacaccgggguauggggagccacccagagugaagaucucccacaagagcacuccaaaagaccaccuacaggggaacacgguuccacgguggcuuagcacagagucaggcugcccuaggaguuccuucccaaguccucaagaaguuaagaguaguaggugugcaucuugaaccuuucucaccucuucagggaccuuaaguucaggggggcagagcacaggagacaagagggcagcaagagacuauacuaugcaaggaagccggaagcacacuguucaugggacaagacaaugcuaccccugccccagugauggaauaagauucccaccaguuuagcaugcagggcccuuagaauucuuucuccugcauaucccaggcaacuguguauuucaaacucacacaucgcucugguguguguagauccggucaaacaacgccucaggggccauccacuucacaggcagccggcccugcaagcagcagcagauguguauaggcgggaugacacagaggacucacggggugaacggaagaugacggcgcaggcagugaguugacaaggaggugggagccagggcaugggacacgaguccacagcccauccuacaagcccuuuuauguuagaccacucaaccccacacgaauacagcaaagacaucgaagcaggaucgaagugggcacgagucuagugguguggagccccacgccgcgccaagcaagaaacuuacguuggugguuuucuuguaguagucgauaugaugaaugucucgagcuaagccaaagucugcgaucuucauuacguuauccucggucaccaggacguuccuagcagccaggucucgguguauacacugcagagagguggagaccagaggagaugacagcccugaacugucacuuacccauccaguccccucuacuccaguacuuacugccacagcgggcagcgggaccguguuaccuugagggucuucugccuucacaccucuauacccucuagauuuucccagauccucucgacgaccccucccaaauauucuuuaauuccagacaccuccaacuguagccuucucagucacuguaacaagccugccuuuaugccuuuuuuucuugauccuaaccucuagcuuuuagauucguaccuccaaagcagaccaccugggcccaugauaggucugugagguguguggguugagcgucgcccucccuggccgggcacgccugcucaagcacugaagccgugcucagaauuuucacagacauaguuaauuuuaucgucacaauaauucuacuauguagaaauaaguacucuuauuuuguaucugaagaaauaugggggcuggagagaagagaguggucuggaggcucuuccagagguccugaguucaauucccggcacccaugugguggcucacaaccaucuauaacaggaucugaggccucucgucauguagauguacaugaaaguagagcacuuauauacauaaaauacaucaauaaauauuuuuuucagcuuuucgagacaagguuucucuguuaguuuugacuguccuagaauuugcucuguagaccagcuuggccucaaacugaagagauuggccucugccccuugagugcuaggauuaaaggcugcaccaccgccacugagcaaauaaaugcaucuuuuaaaaaauuaaaauuaaaauugaagaaaaagaaauacaaggcugagccaggcgugguggugcacgccuuuaaucccaguacuugggaggcagaggcaggcgaauuucugaguucgaggccagccugguccacagagugaguuccaggacagccagggcuacagagaaacccugucucaaaaaaccaaaaaaaaaaaaaaaaaagaaaaaagaaauacaaggcuggguucaguggcacaugccuauaaucuauaaucccagcccuugagagaccaaagcagaauaauuauaaauuucaggccuaucugcccgagucuacgcagaaaaugguuacauagacucaaaccuaauucaaucugaucccaagaccacaaggcucuccuaacucugaaaaccuaacacaacacaaggggccaagcuccaugcacccacagcucuaaagauuaacagguguaagcuggggacagauauaguagcccguguuaacaucccagcaccagagagacugaggcagaaggaccaugaaucaaggccgguguggacgauauagccacaaguuggagugcuaacuggauaaagucccacccugccucuugcggggaaggaugcauucagucuccacaccuucuuagaggcaagauacuccaugccccgagccaccugauaggcacaggauaccagaucuuuggaagacagcuguuccucgggguuguggcugggguuauagcaguacuccagcccaggaggccuccgggccuguagauacucccggagauugccuuuggaggcguacuccacaaugacauaaagaggaccugagagcagagagagagagagagagagagagagagagagagagagagagagagagagagagacaccacaggucaggcaauaggucagggaggggagcugcgccuaauggaggccccuccuccugaugccauaguccacugucucccaugcccgguguaaauguuucccugccgccuccagaagggaacagguaaaaccauucuucccgaaguauccaaaagaagacucccucccaguauaggccagaaaguucccaagcgaagcugaggguaggugcccuaauguagacucuauuaacauuacugucccuuucacacugugaaucuggguguugguaaguaaccuuaaaugaaugccaaucaggcuggcccagcuccugagcaacgcaucaaccccccuggcaaggcaguuucucagccgaugcccagaggccagagcugccccaggagccgccuaccauccugugugcacgcucccagaagguugaugauauucuugugcuucccaaucauuuucaucaucuccaucuccgagaucagauccgacagguccuucuccguugcgucggcuucccaugcaaaccagagagcggggugaggugagguggggugggggaagcggaucccggaggagcccccuuuucuccaggacucccuucuuuccucccacuucccucccaggagccacuacuaccauguaguacugaggguagcuggagacacugcaagaaaaaucagcccguuugugggacuaagaggaccaccugggcccaggacaacauuaagaagcaaggugagauuuaaacacguauauugcuacauccuccucggcuccgguagugacagugugagccgugacugcaucauaggauguuuucgacuaggcccagaccccacuuugcuuagaaaggaaagagacgacucuacaggacacaggaguuccacucacacuucaacaucuucacggccacuuuggucacacgguuggguuuguccuuauccagcccgauggccucagccaacaccaccugcccgaagcagcccucgccaagugguuugccuaagaccagucuugagugggggauaaacagugagugacaguuaggacaggacaaacgugcgaugacagucagggcugguaaagaucaacauccccaaacuccauuuauuaagacaggguuacucuggguagcccuggcugucccggaacuugcucuguagaucagacuggccuugaacuuaagagaucugaucugccuaccucugccucugcuccugaaugcaggguagacagacaugccugcuucugccuccugagugcugggaucaaaggugugugguaccaucacccggaagauuuuuuuuuuuuaauauuuuuuuuuauguauauaaguacacuauagcugucuucagaugcaccaggggagggcaucgguugugagccaccaugugguugcugggaauugaacucaggaccucuugggaagagcagucagugcucuuaaccugcugagccaucucuccagccccccagagcaagcuuuuauaggacagcucaacccuguuucuccugguacaccacucagccaagagcaggaaauagcgaagcuauuucuaaagacaucucauguacuuucacugccuagaaggccuuagcauacacaacaacaugggaacuuggcaguucauuuuaauauuucuugcaagaggggucugcgguggaaaauuacagaacggccagaacaaaagccugggggggcgguguagggugacuguggcaggauuuucucugcccaauuacauuaaaauauuagugcagcaggaagccugcuggacagaaaaaaggggggcagagcgaagaguugcagagacagagagccacucagaagagggggaggagaagccaagauggaggcgggcagacaggaagaagauccugaucccgcgugguuucaaauagcaacagguaguuauaaauaucauauagggacagaauaauugggauaacuugucugaucuaggugggcagcuuguaucacuuaccaguugguucugaaaugauugugugggcaucuugugaacugaaaauuuauugauauauaaaucugccuuguuaauucuagaguuuugcuuuacuggguuacugaaagaugggaccaccgaccacagcgggauuauggcugagagggcacggguggcaggcacugaggcagugaaccagagcugggaagggaagacugcgaucggacgcuacauggagcuuagcuauggaggcagcggaggugggggcgaagaguugcuggcgcaggaacuuggcgguucauuuuaauauuucucgaaacugggauccgcaauggaaaacuacagcaauauuaccugucucguggcagcucccagcggggauccucagggagcucauauucggagacuccagccagcaugggggucccgcuggaggagagccgugagggccgaaccaggagaaccccagaguucauggaugcacuggagucagcugacaccuguaaggaagaguggggucacccuucuagcaaggagagggugaagugguagccaacuccucccaaacccccagcuugguuuuuuaaccacuggacagacuuauuuccauaccuaacaguguggcggaaaaaaaaaaaaacaaacaaacaaaccaaccaaccaaccccauaagggcagaagcucugacugaggaauuucuaccaucaaaacguccuuccagggcuggcaagaugauggcucaguggguaagagcacugacugcucugccagagguacugaguucaauucccagcaaccacaugguggcucacaaccacccauaaugagaucugacacccucuucuagugugucuaaauacagcuacaguguacuuauguauaauaauaaaaaauaaaucuuugggccugaaugagcggggcugaccagagcaaguggggcugaccggaggaagcagagguccuaaauucaauucccaacaaccacacaaaggcucacaacuaucuguacagcugcaguguacucauauacauaaaauaaauaaauaaaucuuuaaaaauaaauaaaaguuuuuuuuuuuaaaaaaaaaaaaaaaaguccuuccauagccaggugcuugguggugcacgcacacacaccuuuagucccagugcuggcggggguggggggugggguggggguggggggcccugaggcaggcaaucucugaguucaaggccagccuggucuauaaagucaguuccaggacaaccagggcuacacagagaaaccuuguccuaaaaaaaauuaaaagacaaacaaacaaaaagucuuucuggguuccaucuuacucaccugaucacugagcacaccaaacagaccucggugagcuuccuguuuucuaacagaacuaacggcucuuuucuuguccccaccacucugcaaaaaacgcuccaccucggguuuacggauuccuagucccuaaaggcaccuuucugggucagcccucuucugaggaaggauuaaucuuucacacgccugcaccuuccaacccguuuccucccaccaugucucaggugacagagggaggucuuuguggcugggguacaggguggacaggcauagagccagaguugguuuauaacauuccaaugugucugguccagaaguuggagcgaaguccaaagugggagaugaggagccaaccaggaggguaggaaagggagcgggccccagaggcccaggaagaggaggcggcaagacaguggugagccugcaaaucccccaucuacuuucuguuaccugucugcgcagagggaugcucuuggccagcuugugcacagccaucuggcuauggaagucgcucuucuuggugccgcucuucaucuuauagaugaugacagagcccaacaugcaggagaucaggaaggccccggugcaguagauaaugaucuccagguagagcggugaggucaucacagcuggucucucuuccagggcugggucaguguggacagugugucagcaggucaugggggcuggggggaagcuucacucacgagaggugugccccaugagaaacccagcaccugccccucuccccugggauccuggcaucaaaggaccuugggaccucugaaguauccuuaaacauccuuaaacucaaaccccauagaggguacauacaaccuagacuauccugcaaaacaagcccaacacucacucacuaacuccagagccaacuugcauaguugaucacuggacuggaagggcaccaaagacccugcauauauguugcacacacauaucauauggaaacaggcugcuaugcccuagagaccagauaguccucaaagcacaugacagagugggacucuaaugaaugcucaucucauguauuacuaaacacccgucaccucuguuagaucaggucaguaaauagcuaaaacacaggcugaguaaauauagugucuaaauaugucucuaggugaaaaaacauguuuuuaagaaaccuauucauggggcuggagaguuggcucagcuguuaagagcacucacugcucuuccagagguccugaguucaaauaccagcaaccacaugguggcucacaaccacccauaaugagaucugaugcccucuucuggugugucugaaaacagcuacaguguacuuauauauaauaaauaaauaaaucuuaaaaaaaaaaaaaaggaagaagaagaagaaaagaaaucuauucauggucccacaggauucuuaaaagguaaggaaaugggaugggggccaggcaaucauuuuucuauguucuuuuaccucuauuuagaauucauacagugcuggcuaguuuuuugucaacuugacacacgcuaaagucauccaagaggagggaaccucacuggagaaaaugccuccauaagagcaggcuguaggcaggccuguaggucauuuucuuaauuagugauugauagggggagggcccagugcauuguggguggugccauccaggugcccugggugcuauaagcaagcaggcugagcaagccaaguugcagccggcacucuuuccuucccaagcugaucucgggguuucacugcugccauagugaucccagcuaagacacacacucauccccacuugcuagucagucuaucuuucccuucagcguaagaaacauugucugccuacuggaaccuccuuguccugcaugcaugcagccuuccuccaacaguccucccuuuaaaaccucagccagccgaagugauacccuugggaguccucccagcccaacaaggaaacaacagagcugaugaccacagggaaguauucuguuggugucuguccaucauccaccuccccucccagccccgccccgcccaucaacugucaggaaaugaagacucacagggagcacugacuaaacagacagagacgaugguagagauaggaugcuucuuugcuagcggcagugugggagacugcugggcaagcaagguggaagggaagaguagagaagguaugcacuuagcggccacagaaagagcagcucucaggccacaugcaaguaagaccauacugagccuguggucaccagcccaccacccggcaaggccacaggguccuuccuuccuggguagcacacugacacagaucuucucacaugggagggcaggccaggagggauauccuaagaggaccaaugggcacuuccagauguccugaauggcuaagacaggccucagguuugcuauccuggcacgucaaucaaagugcagagcagaaugaagagugggccagcaauacuccagggaagccguaguaagcuccuauuggcauguauucauggaggagaggcccauggcuuuccgugggacuggcuaaagaagaccccaucauucaaagccucuguaccaaauggaugagggaagaugcuguacccaaggauggaaggagccugugcuagaaagcccugcugcaagguaaacccagggcucacgcaugcauuacauugaccagggagaaagccagauguacaugugcaaggggaggcugacgcgucacuuccugaaaacccaggaacucccccugcauggcccucaaagccagagcagaaaaggguacgcagcagacgggagccgucccuuucugccucuccccagcccuguaacggaugcgcugcucccauggcaaaaggcaggacccggaaaggaccagugcacuguauaccuuccagaacggucaaccaugcagagugaugggagaguccgauagaguuacccgccaagcacguauacucccccgcauccucaaaggagacauuccguagaugaagcaccuccauuuccuugucggugguauuaacuccagcagucuagaagagacgacggaagcaaaauggacaagcccgggacaugagaccuccgagaggcggagaaacggaggggacagaggaggggaccaaaaccagaagaagaaacgcuccccagcaucuccuuugcaacaaggcaaaaaaaccacaccaccagccagcgagaccuguuagaggaaaacagcgaggcucuggaggggaggcucuccggcagaccugaggagacgacggcuugguuacgacccuucaccagacgcuggcagccacuggcccagccaagcaugcgggcggugggcagcauggagaaaugaggccuggcagguagggggcuguuugguuuuagguaaagagaaucaguggguacagacgggacagcaaggaaagaaaagcagcccccagagcaucccgaaaacgcacacaugcacgcacaacgugcagauacuggucugagagagaauaucuggccccuucuuuuugucacuaucaaaaacuucagucagaaacaucauuccuaacaucucacaaguccgcagacaggcacaaguacuuauacacagaaacgcacacacauagaagaaaaaagggugaggagagagagagagaaacacauauauacauaaggcacaaagggagccacagauaaccaacauaguaccaaaccaaaccagccucccaagccagggauuuuuccauggcucugggcacauuaggaacacagaaggagaaagguagaguugguacugacuucccaaccugccccaguaguguggagccuaaaucaaguacccgguacagggucccguccaucuccccauuaccuuuugccacaggucuggugacagugagccacgcagacugguuagcuucaccaauauaauuggaaaccuuacacacauacuccccgcucugggccucugucacauugaacagggucagcaccuccgcauccgagcuauuaauucccgaaugcuggaauaaaccaacgacacaccagucaguugggcagacacugagaugugaccacacuaugccccugggcgguaacuuccagcccgaggagucaaggcaagggagacgcugagaccuacauagucuucucuucugagugggacaaaaaaauaaaaacaaaacugcuaaugagaguggauagagaugaagagcuaaaauaguaaaacaggagggggggaaggggaggaaaagggaaauggagggaggaaagaagaggagggggucggaggaggggucacugucccaaagcaaacacucaguauauguuacacucccuccuccaagaccggggugggacgggaacucguaauugaagaacgagcuucaaaaaggcccaaagcuagagcuggcccccucuccuccagaacguuuucagcuccaguggcagagagaaagggacagccaguaaaucucuaggccagccaaggcaggggaggaugaggucuaacuucugguuacuccugcugcaagacucacuggagacuuggccaguuagcucccuggauuaauggggcacucgagucugggagcgagagggaaaaggaagagaaugccauuacucccggagcggcuuaggauuuauagggugccauuugcuuuuccaucuguuuaagcagcacccuuaucgugggccuccauucuccaaaagcauugugaacuuaggaaaaacaagcaggaagacaccgggaaacauuugcuguuggaagguuguggucccggguccacgagcaagcaagaguuucaaugucuuccuugaacaacugacccaagauccugggccacuucaaagcucuucaggaaccagccaccagcgucacccacuccacccucuguucccaguucaccccaccccagcccccugcugucaccagccuguggccagaucccuacuaggagauaguaugugacuuauggguaaaguugaacucaaaucccaggcacugagccccagggcacaccuggucaccuucccagcaaacuagccaagaaaggagguuaagaguaccuucaggaucuggacauacggcaaguugucuggcccgaucuuacucccguucaccucgaugugcuucagccacugaaugugaggcugcggaucgcuguacaccuuacacaugaacuccacauugcugcccagggccacugucuuguuggcaggcagcccugccugaaggaugggucggugcggagaucguucugugggggcacagagaggacaggcaugucagacucuucacuggccaguggugaggccuacacugaccuacaguauccuucccacugcuucugcuaaacuccugcccuuugaaccugauuugagagaagggguaccauuucuucuaguccugcacucacauuucuggacacaaccaagucucuugucuaaauagagacacgaccccagauuccagcaucuuagacccuucccagaucucugagaucagaaucuucugccugggcuacaucaaugccaaggcagguauucacugugaggugcuggaccacaccgucucuggagcagaagacccagaaccuuuccaaucagagcccugagaugagcaacaugguguuccccugucuuccaggauacuacaccaaguggacagaauggcgauucuacauuucaaggcacuuggccucugcaccccagaaugugcacuuggcuuauacagauacucuaaugguaccugugcugcaaagacacaaaggucaaaguucagggggcacggacuugcgccaccaugcccggcguuagugguguucuuuaagcaacagcuacuguugggcugcauuucuccuugcuauaucaagcugugucuuccuagacauguaguguaaaguagcuguugcuuaaugaaugauuuuuuuuuaagugagccaggaacaguugugcaugccuuuaauuccagcacucaggcagaucuccagugaguucaagggaagacugaucuacauaguaaauuccagguagccagggauacauagagauacuuugucucaaaaauaaauaaauggaaggaagggagggagaaaagugaggcuuaaggcaaaccugugagaggaaggaaggaaggaaggaaguaaggaaggaaggaaggaaggaaggacagagggggggagagagagagagagaaagaggaaggaagggaaguaagaaaggaaaggagggagggaggaagaaaaaaguaaggcuuaagguaggcccaagccuuuaaucuuagcacuugagagguuggagcaggaggauggccaugaguucagagucaggcugaguuauacagugaguuccacagcugucugggcuaaagucugagaccauaucucaaacuggaaagaaggaagaagggggaggggggacagaaaguaaaguucaaagcgggacguuuaguaccaaauguccagagcccauccuaggaccucagccuccuccgcugcccuuuccugccccacccuugccucugccugccucuugcccacuuagccuucuuacccacgacgucaagcugguaggugugguugaugcucccauacucauucuccacgaugcagguguaguugcccuugucagaaggcaccacagaauccauuaugaugcuccagguggcauagcgaaccuguggggcacagacaaggggcuuugcugaggaccugggggcagggggagggcagacgagagccgcacauacggccagugcugcacuguuagccacacaaagcacaggacuagauccuggucuagucacacucagaauccuuccugcaaacuaaaacugacaagguccaugaagacgcuggccaucuucacagcagcguucaggagcagcggggagcuggaccaacgcgccuuuggccaauucuccuaagcugggaauccucuccgugcucgugaauuucacaccuaugccugacgcggcaaguuucacaagcuaucuccucaggguuggcaagauggcuccguggauaaaggcacgugccccacguggugggaggagacaagcaguuccugaaaguugucaucugaccuccaugugcacgccauugcuugcgcaugugcacacaaaaugaaugcacauaaauaucacacagaaacccccguugcuucuaguugacucuggucagacccguccuccuccuucccgugcucuugcauggaggagcucccccugcaggcugcuuaccacagcugcccuuugacagucgccuucagaugugguuacaaaauccuaacuugcaaacaaaaggacuugguaaguaaggccagguaaagcuuuccccauauucuuucuuuaaaaaaggaaggaaggaaggaaggaaggaaggaaggaaggaaggaaggaaggaaggaaggaaggaaggaaggaaggaaggaaggaaggaaggagaaaaagaacuggugguggugaacacuuuuaaucccaguacucaagaggcagagacaggcagaucucugaauuccaggccagccggaucuauagagcuaguucuaggccagccagagcuacacagagaaacccugauugggggugggagcggggagaacaaauaauuaauaaugaauagagaaagaaaaagauugugugugugugugugugugugugugugugggugugugugggugugugugcgcgcacaugugaguguagguguccacagaaacccugaagcuggaguuauaggugguggugaguugcccgaggugagugcuggaaaccagacucugguccucuggaccagaguagagugcuaucugcuuaaucacuaagcugccucuccagccauccccucucacuuuucuuauacaggagcaaugaacagccaugcaugguggcacaucucugugaucucagcacauggaaggcuaagacaggagcagcaauggaaguucaggccagucuggggcacauagagaaggaacacaguaaaaaaaaaguuaaaaagguaugagaaaagagacauauuuggggaccuuggagacucaucagaucucuaaggaagagauucucaucaaaauguucuuccuacaaauacaaaggacuugaccccccggagggagaggaagcagcuuaucagcauaggaagugccuaaugguaucaaaaagcaacacaaacguguucacccagcuguacuucuuggcaaaugucuagugagucugucauucgaauauucuguuacggaaggugacugguuuuuccuuuuaggacuugggggcugaagaugaaacucaacagugcaggcuucuaacacccaacagggaagcggaagcacuggggaaaggcaugggagagagggaaauggauuaugggcacuaagagcuuaaaacagaucuaccccgucggaucugacaauuccacuuccaggaaucgguccugagaaagguccuuuaaaagugcacaagaggaccagucgugguggcacacgccccucuuuuauccuagggcccggauugcagaggcagguggaucucugugagccugagggcagccuggucugcauagugaguucuaggccaggcagagcuaaggagagagugagacccugucucaaaaaccaaagggagggagggagagagagaaaggaagagaagagggagggaggggagggugaaugguggccuguaaggugacucaacugguaaagaaagggacuugugaccaagccugcugaccugagagcgauauucaggacccaccuaggugaaggagaacugaguccucccaguuuuccucugaucuccacauaugcauauccucccgcaaauaaaaaaauucuaaaguaguaaaaaucaaaacacugcaauucccaggaaucugacacccucuucagaccucuguaggcauuaggcacacauguggcacauacauacauauauacacacacacacacauacauacacacacacauacauacacgugaaaccauuauaaaauaaacuuuaaacuaaaacaacaacaacaaaaucucaccuuuacaaaggcaaccaaaacaacaacaaaacccaaaguaaucauagcagauaauagagacuugcuaucccaguccccgcucuagcgccuuacucuaacuuuucuuugguauguacacacgcguaccuuguagccuccaauucgguggucaggcuuaaacucuuugccauuuuucaaccagcgcagagugggguugggugucccacucgacgggcacuugaacuucaccgucuuggcagcgggcaccgcaugcaguuucuucuccauuuucucuggggauguccaguagggagcuacagcuguacaggaaaagccaaaggagacgaaugagggcagcaggggcggccaggcucagaagccagggcccaggcaggaccccaugccucccgucuaccuguucaguaaguacccuaggucuucuagagaggcagcaaccaggcaccauggcccccaggcccucugagccucucuccucccacuuuagccaggccuuccucuaagucccagcucccagucucgaaggcaguaagauagaaaacagugucucacgccuacgguuugguuugguguuguccgucucuuucuccuccgaggaggagucaucgucgucgucaucaucuuccgaggaugggagugcaucugugagaggaaggagggggacugaggagcgucuagaccuccauccaaacagcauucgcccugucuagacagaccaccucacugcggucaacgcggugacauggauaacgcaacagccgucccauaaggacucccaauuuuccugaauuuugccucagugacaguuuguguuuaagagcugugugcuccagugcucaucccggccccagcgcacugccuucugccuaaaaguucagauggcucuaucagggccagcuccuuuuuuucccccaaauuuauuuaauuccagccuauacaccaaggccacucagcuaacaguaccacuuggguauccauaacagcagcugaggaaucaguauucucuggacaucagccuuugagaaacccaggcagaucuagacaccugggccuugaggcuacuucuaaagccuccggcugaccagccugcaaucagaaucuucuggaaugaguuuccugagggcuggagcugccugcuuuccuuucucucucucucucuuucccccaaagaugucuuauuguuuuuaaaacuuauauguaucuauaugagccugugugaguaugucccauguguaugcaggagcccaaggcgggugggccagaacggggugccagauccccaggaccugaaguuacaggcaacuguaaacaagcuaugugaaugcuggcaaccaauuccacucuacaagagugucaggcucucuuaacagcugggcaaucucuccugccccagagcugccuuuuugguggauguuuuaagacagggugucucaugauguagagauguagacaaggcuggcuucaaaaacaaaacucaaaaacauacauccuguagagugcagggacuaaagguguacacuacuaugccggcuauagcuagccucacuccccaaaugggaugcacuuuguguaaauacaggcuauguucaguagcuucuuuaaucccagcacccgggagggagaagcaggcagaucuuggagacucugaaaccagccuggucuacacagugaguugcaggauagccagggcuguguagagagauacuucacucugaaaaugggaugcaccucauuuuuuaaaaaagauuuauuuauuauuauacauaaguacacuguagcugacuucagauacaccagaagagggcaucugaucucauuacagaugguugugagccaccaugugguugcugggauuugaacucaggaccucugaaagagcagucagugcucucaaccgcugagccaucucaccagcccaggugggaugcacccuauuuuuuuuuuaaaaaagucuugauaucuacuagaggucucucuaguggagagacugccacucuugggaacuagagaaacauguuucuuaucuggggacaaguucuaaauggugacuggaaugagguaccaagcccccaucauggcacaaggaaaaguuccugccucuuccucagacgcugguuuugggaaacugacauucuacaggaagcauauucccagcaaggagaguucuaggcucgcucccugguugcuaggcaacagguuuuccccacaaagcccgaacucggcagcaaaccguacugaguccuuccaaccacagcaggaacuuuacuauauguucucaggucccaaucacuaagccuaggccuugacaagaugaagcuggcgagccccacuuagcgugcucuggacugcugugcuggagaaaugacagggucuuaacacccccgagcauucauaaucaccucugagguaggucuuagcuuggcgucugcccuacccggucaacccgagagcgccaagccacgcagcgggcagggagcaauguuagugggcggcaguucugaagcagaguaggggcgggaucauggaggggaagcccgccucccuuucaaacuagcaaaguuggaggagugggauagggcagagggcauugcuaccaaccugagacauugacggagaaguaggugguaucgcugccagaggggcugcuggucacgcaagcguagaggccagagucagcggggauggagucccgcaccuccaccuccuccccugugaugcggguacgguugcucuccaccagcugcaccccaucccgcagccaguugaugcucugcacaucaucgcgaagccgacagcgaagcuguagcaggucgccaggguggaccaggagagacuccacuuccacagggacuccccagggcugagcugcagcagccacccacaagggccaggaggaagagccaaguggagaaaggaggaggagaaagggaguuaggugagccauagggcgagccgagucguaggucacugcacuguccaggccuuagcuaaggcaagagagcuggggaccggaacguguaucagucggaaaugaugggcaaaccgagguccccagcucuucuccaccccgcuucuccaugagucaaagaagaaagaggcaaaguuaggaagcagccgcagcagcagcauuaagcaguguuucaacuuccacuguucuaaggggaagggucuccccgucucuagaaugcccccuuccccauaugcugcucaguucuuugccacuucccaccagaacacaccccagucggccucaccccucucccuagcgaaucaagccaaccaaccccucacgaacccagcaaccccaaugcccaagaugagagcaggcauuuggucaacaggggcucuugguacacaugacucagcgugggugggggccuggcccuccagcaacacagaugcguuugugggaaggacagccaaggaagaggucagcucaggggagccuccagcuaacagguguuaggcccaaggccugcagcugccaccacggcacauuugcucuggcaacagacauggcacacauaaagcccuccucauccaucgcuugccugggcucacccucuccugcaccccaucuuucuccuugagacacagugucgcacuguggguggugugacugagaauggcuuuuggauguuugauccuggguuggcagaacuguucugggacagagugagaggaggugucuuuguugggggagguguuauugcuaugaguaagguuucaaaaguccaugccagaccaagucugucugucugucuaucucucuuuuuuccuucccucuaacuuguagacagcagguaagcucucagcugcaguuccagugccuugccugcccgugugcugccaugguugccaccaggauggucgcggacucaccccucugaaacuguaagcaagcccccaauuaagugcuuucuuuaauuugccuuaguccuggugucucuucacagagacagaaaaguggcuaagguacacacacccuuacacauccccuucuguaucucaaccagaacaagaccuaccccccccccaacauccaacuauggaaagcacccauccugccuuuuuuuuaaauaaauuuuuaaaaaagauuuauuuauuuauucauuuuauguauaugagaguacacuguagcuguacaaaugguugugagccuucaugugguuguugagcauugaauuuaggaccucugcuuacucuggucaacuccagucgcucagucccugcucacucuggcccaaagauuuauuuauuauuauauguaaauacacuguagcugucuucagacgcaccagaagagggcgucagaucucaucaugggugguugugagccaccaugugguugcugggauuugaacuagggaccuuccgguagagcagucagugcucuuacccgcuaagccaucuggccagccccugcacccaccccuccuguggaugagcugcuuuagucaugugaucagaaagacccauauucuuggcacuaccaguagucagccauacugaccaaauaaauuaaucccuuugcuaaggaggaagcaaagaacuuucuggguuuuuuucugcacauuuaaaugaauggcuggccuggccuccuccucugaagaauguucuaggugccggaagucacgugugccugaaacucugaagcagcucccccaauccugcucugacuccacccuuugcuucucucuaggaguuuaccaucuaguccuagaacuggcagggaucucaggucuaaccaccaucuggccuccuucuugugucagggucucacuuugcagcccuggcuagcccagaacucacagagguccaccagcuucuucauccuccaugcugggguucaagguauguaaccaaccuuuacuuacaccgggacuuuuguuuuucugagacaaagucuuacuacauagcccagagugccuugaacucacuguauagcacagauggccccacagcaucugacacccccaucccuucuuuagcagugcuugggguggaagccagggcugggaaaaggcugggccacugagcgccuuguggcuccucucucuuuuagauuggucuuauuuuugacuguguguaucugcuugugucugucugugggcgugugcauguggggugugggucccuauggaggcgagcagugucccaucaacuaaagcagguguuacacacaguugugagccacgugacauggggaguaggaaccagacugggacccucccuacucugauccucuuaggagcuaccacucuagccucuaacuucucauuuuaaugagccucucucugaagugguccauugguuuugcacuagaagccuuagguccauggggguugaccauggcuuuucuuccaaggagcucacacugcaguuuaucaaccuaagggcucucucuucuaaacacagugccaucucaaguuagcaucugaauaccaguaagcuaauacauguuuauuuuuguguucuggucaaggagagcaccagaggggaacagaacgcacggcugauuaaaaauagcugcugcggacuauuccuuccauucuuagugguuuaugguuucgccaaaaggagaaaaacagccuggauuugacccugaaggaaaacagcaagcgucccuuccgccuauugauccgauuucauuuccccucaagugaucucacugauuaaauauuuugcugcucucgauccccaccagccacuagccacuggucaacaacagcgaagucaaauucucagagucaggcaucgcgcagucuacucacacaggucacagagacaaaacaguagcucccaaagaacucagcgaagagaacggaccggcacugcucccaagggaaggagccagcagccugcccuuucccauggucguaacuucuagcuggugcugaccaaugugggaaagaaacucaucucugagcuaagaaagccucggguaccagcauccuuguuucuacauuguucucuccccccccccccaacccccacugcugcagcuauccugggacagcacuacuccaagacccacccucuaguuuacauagucgcugucuucaucaaaaaaucuuacccuagauauaaaguaagacccaagucccucuuucuuuuuuuucccccccuuuccccccuuuaauuuuuugaggcaggguuucucugucuaacccaggaugucugggaacucacucugaagacuaggcugaccugcugggauuaaaggcaggugcaaccauugcuuggcccaaaucccucuuggccuccaaaggcuccugacaacccugucuuccuacuccacccaaaccuggcuaugccccugcacaacugcaccaucccccugcacagaaaacggacuucugaugacaccagucauaaccucccgaguucuccugccucaaucaguuagagucuacaggccagaaaaaucccagcagcagacauaccagucuacauagugguugccauccauauucaggacagacaaaaaaaaaaaauucugcccauagauucuccaucugugguugauugaucccacagacaugggagaauagcuguauauuccgaguuagaaaaccauuccaaaaaaucuaauuucagacuauuuuaccucccugccucaaaaaaauccauagucauagaacugaauccucauccccuacacacccuauagauagacaaacagacagacggacagacgucagacacacacacacacacacacacacacacacacacacacgguuucucaauagcccuggauauccuagaauucauucuagacaagccugcaccuugaacucccagagacugccugccucugcuuucuagguccugggauuauaggugccugccgcuacacccagcacccuuaccacauacuagcuaucacuguuccauguauuucagucaaugggaucacacucuguaugguauuuugugaccgugucaagaagaagcaaggcccuucuaugucagaguuguucuccacacuucuuucuuuuuaauggcugaacaguguuugggugcauagccaguaaccagagggcaucagggaguacugucccucagugaugacaacaccagggaguacugucccucagugaugacaacaccagggagcacugucccucagugauggcaucagggaguacugucccucagugaugacaacaucagggagcacugucccucagugaugacaucagggagugcugucccucagugaugacaucagggaguacugucucucagugaugacaacaucagggaguacugucccucagugaugacaacaucagggagcacugucccucagugaugacaaguacccauaccuugcuucuccuaagaccuagaaagcaacccagaccagaacugacucuuacaauuaacaccaggaacacagaaaugggucuuuuagaggacucauuaaucagccaaggggcgguaaaguauuaguggcuuucuucauugauagcagaggccuuagauauauggguuccccauuuacaaagcagcuauaaagaaagcuacuuuguuguggaaggcauggaaagguaacaaguuggacuauuaccuguauguuagagugguccugacauugacccuguuacuagguaacgcucacuagcaacucacugccuugguuaagaauuguguggaacuuacucacauauuccuuugacaagacguacuugucauucauagccucuucugagcuugacuuucucagucaagaccaauggccuggagcuacaguguggcagguuuaucagccgaugagagaacagcuaacugcuacuuucauuaaacugguugugaaggaugcaaaagggggucauacucggccaaugcugaaauccacauuccagucuugauagaagacuggauaggauagcaugggguagcaugggauagcaugggguagcaugggauagcaaggaguagcaugagauagcaugggauagcaugggguagcacaggauagguaggauaggauaggaacuuguugaacuaaagcacagagcuaaccagucagaucaauggugcaggggcaaggcccuugcugccaagccuuagaaccauguggugggagagaaugagcuccccccggccucacuacacacacacacuaaacaaacaucaaugucuucuaaaacugcuggguugguuuuuuggacaggaccucacuauguaguccuaucuggccuggaacucacuagguagcuggcuuccaauuuacaagagaucugccugucucugcuucccuuguauugagauuaaaagugcaucccuccaagcugacugaaaaacauuuuaagugggcuggagggauggcucagagguuaagggcacuggcugcucuucuagaggacccagguuugguuccuagcacccacauggcagcucauaaccaucucuaaugccagucccaggauauccaaugcccucuucuggccucuuugaaugccagguauacaugugaugcacugacauagaugcaggcagaauacccauacacauaaaaacaaaaauaaauaaaucuuuggggcuggagagauggcucagugguuaagagcacugguugcucuuccagagguccugaguucaauucccauccauaaccaucuauaauggaauaugaugcccucuucuggcauacaggaguacauguagaagagcacucauauacguaaaauaaaucuuuaaaaagauuauauauauauauauauauauauauauauauauauauauauauauacacacacacacacacuugggggggggggcaguguuucucuguguagcccuggcugucuuuaaacucagagaucggccugccuccgccugcgccccccccccaaccaguacuggcaucaaagcaugcagcuauaauaacaguagcaaaauuacagucacgaaguaaccacugcucuagaaggagggaaaacuacaugucaaccuuauccucuucaagaaaucagccauaaagggcagggaaggagaucuuuuucauaguacuuuuauguuaaagaacaugauaaaugugaaugaaaccuuuuuguccccuuuccuauuuguacccccaaauacuucagcuauugggauaacuucucaacaagccaagaggggccgcauuuugcuuacaccagagcaggccggaagugauccagugguuuagcagguuaauucuggucugaggaugucgaucagauccaucuccccacucgaaaucuggucucugacaugagcccuguaucagcgggagagcggagccuggaggcccaaauccauauaaaucuuauuaugcuuccgcuuguacagcagucaauaggagacagccauuaaagaaauccucgggggcacaccugucuguggagaccgccaaugcagcccacucgugacacaggaaucagcagagcuggaacagcaccguaugguauaagaucacuuccugggguuguaagauggcucacuuggcaagaaaacuuccugaaaagccugacuugaguucugccuccaggacucccgugguagagagugguagagagaacugacucuuacaaacuauccucugaccaccacaugugcacuauggcauauacacaugucccugaacacgugcacgugugcucgaguguaugugugugcacacgcacgcgcacacacacaccacuaauauaaaauaaaugcaauuuuaaaaacuuauuaaauuuauuaaaacauaccccagcccugcuucuauaaaacauggacugaggacagagcaugcccaacccccacauuuuccugugacuucaaagagaagaggcagcaguacuacacagcacuuuaccauucacugcccccccccccgccccccagcuucccauucacaaccaugcaaaccagauacccacacacagcaggccgaggguuucuccaggcugugaguuaguucaucguguucucacuauccuguggcugcggggcuugcgccauguacagcucgucuuguguuaccuaauuggauccccacggcugauaaaauagggucccaucaguacccuuauuucagaggcgggggaaauggaggcagccggagggauacaagguacagggcaauccaccuguguaguaagcguuacaaagaggugggagccaaaccugagugccauggcucuucagaacacaagcccgggcacagcucacucuuucacccuuucauuuacaucacugugucuuuuguuuugcucccucacccccaccccugcccaucaagacagaauggccuaggcuggucuuccauuuauuaugaagcucauagugacaagccuccugccucuggagugcugggauaaaugagcuacugugugugcacaacuuagcuucaccaugucuuuaaagucauugauuuuuuuuuuuucuccccgagaucugcaaagcgcuuuugguucaacccuuuaaucucaucuaauagagcccaguugccucccaucuucuugcaugggauucuaaaacuggcugcucugggcuuauccugcccaucccacccccaaccucacagcuuaaucucaacaauaccugaagaauucauuuaccuugcuauguguagaggcacacaacuugaaucccagcacucuggaggcagagucggggagaucuccgugaguucaagggcagccagggcuauauagugaaacccugucucaauacaagcaaacaaagcaaaaccaaaaaaccaguguuuuuuuuuuuuaauuuauuuauuauauguaaguacacuguagcuguccucagauacuccauaaaagggcaucagauuucguuacggaugguugugagccaccaugugguugcugggauuugaacucaggaccuuuggaagagcagucggugcucuuaaccacugagccaucucgccagcccaaaaccaguguuuuuaacuugaaggaacuucuccaauugagcagguuugggaauuggguguacccuccucaguggcaugccccuaacuaaucauuggcacugcaugugacacuuacaaaacguggucauuugugcucgagcuccuugucuuugccucccauuuaagagagguugugagacuuccugcaaagucacaaaacaagaaggcucuagcuguguccugggcuccuccccgcugcuucucacccgaagcguguucuaaacaguuagggaugacccauggauggcuugcagacacagcacuguccucacagcccucccugcuauccucccaccacacccaccuccaucccugcagcucagcucuuagcagucaggacagcugagagcugucuucuuacccgucauuuacagcuuacagcugauaaccucuagcgccauccacauuagucaauggggcccggacaaucuucuccuuggccgagauccauagaucagagguccugagagaaguccggcucaacagcagagaugacacgcugucugccgucucccucacacucugagauuccccagccccagcuuauucccuccucaaggauccagagcuguggguagcgguggcgcacaucagccccagcacucaggaggcagaugcaggcagagcucugugaguuugaggccagccucaucuacagagcgaguuccaggauagccagagcuacacagagaaacccugucuugaaaaacaaaauccagucuuuuagcugucuccucuccccugccucagugaucccgucccccacccccaccccccacccauuucuucauuaucccucacaugaagcuuuuugccacuuuagagacuuugcaucucuuaaaugacuuuuucuaacaacaacaacaacaacacaaauagaucaaauuacuucugaagcuuacaguagaaaagcgacauuccuugcucccuccuucuuucccugugaggcagggacuaccaagcuaucagugaacacccaagagggaugcuggcaccacagguguuuaugaccacaccacaucauguggcgcugaggauggaacacaaggcuucgaagaauccaggcaagcacucucucaacugagccccggcaguggcugcugggauuuuuuggucugagaaagggucucauuauauauauccuagcuggcuugaaacucaugcaugguuucauggcuugaaaccaggcuggcuucaaacuaacagagauucaccugccucugccucccaaaugcugguauuaaaggugugugccaccaaacuugguaacuagccccuuuuuuguugguucgguuuagggacagcccaucccccaccgccauguagcacggggugauccagagucaagauccuccugccucagccuuuugaguugaaaucucagguguguaucaccaaguguggccuucaucccauuuuuagauguacucucaccccgagacucgaaagcuucaucuguacauuuagcccuguuuuccugacagaacagucuacacuaguguagcaccccucaaaggucaggaacgauaaagacaucuuagguacccaaagacucccuucgcuaaauccagacaggggugcuucgaguggucucagggucagcucccccccccccccccgccccgugaaaugccugugguugggauuuuuuuugggguuaaagaaaaugaagggagagggggucgucucagcaacaggagggagaugguggucugggaauguuuacagucuuggcacaagcucccagugauaaguggggagcaauuguggaugugggaggaauuugggguggcauugaaagaaacuaagaaggaacacggcgggggcuccaggggcccucagcagagguuuuuauuaccuuauucugacuuugaaauggaaccgaaaacuuaacuuucaucuagcaagaccaagacagaacaagcgaucacaguaagaucccaggugauaaucaucacucuccgagggacccggcaccgagaaggggacacagagaucuccucaauacaaggagggcugcaaaacugggggagcaaagguguguugugguaacgaaaaccgaagcaccagucaauuaccaggggccuuucuccuggucagcagcauuuggggaccugacggggguuuggacagguuuuuuuuuuuuuuuuuaaauaggaaaaagggagaggagcaagaaggaacauuuugcaugcaaaugggccguugccagaacagcccauuaaaauguaaaacuccacauugggcugacaaaauggugcaaagcgcagugcuugccacaggggccgugaugaagcacacaacaaagaggccagggaacaacgagagcugaauggccucugucagcagguccccucucucguugccauggggacuccacccgggcuuacuaaagguauuuccugaggagaaaggcagcacacacaugcccaggcagccgagcuaauccugacaggaagccacggccauucaggagcccaggggcuuggggcugaaguuuuguuuuguuuuuauuaaaaaaaaaaaaagauuucagucuuuugugcgccccaccucaucacuguaauuuaguacggagcugccaaagccgcagcuagcuaggguccuugcguccaccacaugacacccccaccuccccagcugggcucaaggagguaacaagggaaacccuuacuugggaguuuuguuucguccuuacaaaccuuucaacaaaggugugcaccaggacuguguucagucgggacacaaacuucaugccuguaguuuucccacuggcguuauggugcccaggcccuggugccccccccccccgacucccaccguagcccgguccagcuggaaggauuguaauuacaugauuaagaaaggaaucaaauccccccuucuucuccagcaaagguucuggcucugcugguaaaaaccuggaccaagcacgaaaaaaaaacccaaaucucuuccuguacccuucuccccaacugggucuuuaauccauugcuccucuuccuccuaguuuacuggccagaaagaacccaaaaagaggaugcccugcagcuccaggaagggcugucugugcucagggcucccaggaguuggagucaccaugucucacuuggcaccagaagaaugcagccauggcagauucggggaaggaggccaaccacacagcuggcagcagaagaaaacugugugacaacugccuccuagggcaguuuaggguccacugacauuuccugagcaacuuaaagucagaagauccauccccauaguggggauggggguggggggguggggggacuggagcucugugacuaaaacgugggccuaugccaucauguacuugcaaagcguguuuggggaguuguaguccuccagaggacuuauggauacccuugcccaacacacacacacacacacacacacacacacacacacacacauuaugaagcuucugugauuguacuagguggcuucaauuuuggguuaaagucgcugcagacuucuuggaagagccuagcgccguaagcuguaagcaggugagucuugucauagcccccaucacccaaagucacuuccucaauucgaaucggaaacuacaauuggccaccgaaugauagagaaaagccuaaggccugcucugcuaaguugugggccaggaagggggguggggcggggaggagagaggguggugguccuguugcuagggcgguagcuuggacccucccacuacuggcagggagcccaggccucccagccaugugucugcagcugcgaccugucauacacuuccuggucuggguucuguaaugggaagaucauuaaguaugggggagggggaggggggaauaagaggacucuacagggaagagguaacucccgaaguccgcucuacucuaggcccugaccuuaaagucuggucagguuccuuaaagaaaggaaugcacugcccugcccccaagcgcccgcccggggaggagccuucuagggccgccccuccccccaggcuccgaagcuccaguuuggagaaggaaaaggccggcagcugggcaggaaaaguugcaguccccaaaaaacuugcugauccauucauccaguaggagugucagcuguuucggaaugugccuucugucccccccccccccaaaaaccacagauggugcccgaguuaaacgguuugguuacguguggccugcggucuguccgcaccgugccaaugagucuggggguguuuaggucagagagcccagcauuagaccacccaauccaggguggacaaauagccuucucacaaagcgucauguuauucccugccgugaagaaaugcccccagcuggggagacaccuuagggguggagggcuuaauuggaauucuagagguucuguuucaaucuccacuaucacguucacucauagguuuaaaaaaaaaaaaggguggggugggguggagugacucuuuaguagcacucacaccuuaaaucccagcacuguguauguguaugggguagugcauccagagacagaggcaggcagauuaacuaaaccugguauacagagcaauuuccaggccauucagacuaugcaacaagaucugagaccuugccuuuaaaaaaauaaaaaagucccuuauuuugcauuaugaaaauacacaaaauaaaaugccuuaagauaaaauaauacagcaaaagcugguuacuugguaauaggcuaucaauuagggaaggcggaagaucccgagauugcuggacagcaaugugaacauagccaugguggcucuugccuuauaagccuggcacuuaugacacugacgcaauaguacuaacaaggcuagccugggcuacauagcaaguuccagaacagacaaggcuacccagagagacccugucucaaaaaaaccauacaaagguuaaaguggagagcuuuagguuacauauaucuggaccuaacucgcucacacaaacuacaagaccacgaagaucugggagcauacauguccaaaauggagccucauuuauagccccugcuuguccacagaaugaauucacucuucggccucuaucucuugcacacacaguaucaaaaacaagcaagcagucuuugcuugaaugcucaaaagagcauggggggggggucugacuuuugaggggcucucuauaccuuuuuuaccugguaauccagaaccaugggacucuugggguacauacaagcuucccucagcuaagcaacccuaaugaccucugggaagagaggucuaacauucacucaguggcaggcccagauuaagccaacacaguucagcagagacagacaacugugcuagagagccuaguaccuugauucugggcuagugauguccugugaagacccagucuccaugugggcuaacccccagcccuaggugccuucuggcuuagcguccacauuucacccgaacgccaagauucuagagucacugugcccggccaacuuuucauuuuuaagauuagaguuguuaggguguggagagaugacugagugguugaguagugacagggaccugggguucaacucccagcacccacauggaggcucacaaccaucuguagguccaguuacagaggacccuagcagggugcuguacacacucagugcauguaaaugcauugcagcccaaacacaaagcagguaaaauuuaaaagaugaaaauaaaauugaaaacaaagagguaccuuuuuuaaaaaaaugaaaauggagccaacauaguauaguggugcacagcucucuaauccccgagcucgggagguagaggcagguaguucucugcaaguuugcaaccagccugaucuacaucguaagacagguucauaaccacuuguaauuccagcuuugggggaucugacacucucuucuaacuucugugggcugcaguccugugcacauacauacauacauacauacauacauguaauuaaaaauaaaucuuaaaaaaaaaccuuccaacuauaauauaaggaaaguagaaacuauaccauauucuaggcuacucgcaagccaugcagccuuggcugcaaaauaacugauucuucauaaaccauuuugagaugaggcguuuugaaaacugaacccagacccucacacaugucaaacaagcauccagccaaacacuaaguuacaaccucuaccuaaauagucucaaacucccaaucccccugccucagccacccaaacagauuacaggcauguuccuccauuggcuaagauuaggcucuauguuuccugcuuuggccaagcuucagguaaaaggaaguccggcaaacacauuuaaagugggccaaacuaugauauagaguagguuggauguacuaaagcauuuuuaaaaauucuuuauugucauucuguaugugcacacccaccccacccccuacacccguggaagccaaaggacaacuuuguggagcggagucaccccuucucccauuacagaaguucuggggauugaauucagcagcaagugaucacccaggcuuuacguguagcaaguguuuuuccugcuacaccaucuugucagcugugaguaugcgauacuuuuuuuuaaagauuuauuuauuuauuuaucuauuuauuuauuauauguaaguacacuguaccugucuucagacgcaccagaagagggcaucagaucucauuacgagugguugugagccaccauguagcugcuggaauuugaacucagaaccuucggaagagcagucagugcccuuaaccacugagacaucucuccagcccuaugcuauacuuuuaauuauuacuuuagaaugucacccauuacauaggaaagguuuuggcuuaaguuuaaucccugggacucacauaguggaagaagaaaacugacuccagccaguuauccucugaucuacaagcacacacaugcacuucuuccuuuuuuaaaaaauuucaccauaaaauuaggugcagugauauaaaagccucagcacuugggagacggaggcaggaggauugggaguuugaggcuagccugguguagaugagagcccaucuuuaaaaagaaaaaaguucacuauaaaacaauguuucacacuaugccaagagcagccucacacauucaauguuccuccaacuuuggcuguauccugaucucuuguacuugguuuaaacuuguguuggcuuauuguggccuaagaccaaggucaaauaccauauacacagagguacgcacuauauagccuaggugugcugggcuacacuuuguaaguuuguaagaacacuuuauuuugcuugcaugaugacaaaaccuuuucauaguacaagccuccagacaccguuaaggcaacaaaucaauauaaucaauauaaauacgucucuguauauccaaccauaaugaaauuaaugagcugguacugccugcagauaagcaguuugccccuuuacuuugagcccuuuggcccucuuaugcagugugagauguucuuauauaucuugucuuuauuugaugugggcuucaaguaucacucccuaauuggguuauuuauuauaucugcaagucuaugaaaacauaugggaguguaccacuuuaaucucagcauuccagugauggaggcaggggaaucucuaugaguuugaggccagccuggucuacagagugugucacaggacacccagggcuacacagagaaauccugucuuuaaaaucauaauuaaaaacaaaaaagaaagaaagaagagaaaaugccacagagcaauccacuacacacagccuaaaucauuuccugauagcagaaggguaaaaauucuguaacccacacaaugcaauauuauauaguuacuaccaaaaaaaaaucuauauaggaacagauuuaagauauaagccaauauauacaguauaaauuccauuucucagauauaaacacaagaagaaaaucuaaaaaaaaacaaaaaacaaaaaagauucaggccaacugugauuauugauggaugaugagaaucuaagacauuauuuaucugucuguacaagccuguaguuucugauuucuuguuauaaacacauaucaaaauaguguuuuggagguuuucuuguuuguuuuuauuuuuguuguuuuauugauugauuguucuguuuugcuuuuugaaacagggucucuguagaccaggcuggccucuaauuuacagaaauucaccugccucuacuuucagaguacuagaauuaaagguucuacauccaucaaaucaauguucuuaaagacugacagugucugggcuggagagauggcucagugguuaagagcacugacugcucucccagagguccugaguucaauucccagcaaccacaugguggcucacaaccaucuguauguaacuuuaguuccgggguguguguguagggggggagcugacgcccucuucuggucuuguccggaacugcaagcacugcaugcacacaacacacauaaaauaacguggaaacaaaagaaaccccaagaaagggguggccuuuuaaauaaaaucuuaguggggacccagacuaaaucuuaaggguaagaauuaaguacauaugauuaaagaauuauaaaaaguugggcggggacgggugggcauuucauguaaaaggagagggacaagcaauggucauauauauggugcaugcuacggucaaggaaaaaauaggaauauacuuggcuagaugggggagaaucagugaaggaagaggccgguaaccagccugagccuagcagucucuguggggaccaugggggaggaaaggcugaguccuggacucaauuuucuuugcuaauuaaccauuugaaauuucaguccugacguuuucuauccagacucacaggcggcaagucuacauuuugcugaauucccgggcccucuuacccacuuugccuacacauucagggucuggggaacggcugcuuucaggcuaaccaagaguaccgcugcccccaaaucaccucucuuacaggagcuaucccaggaggcucaggagcacagcaacucagcagauaggaccaccgguguacuggguuucaacucucacccuagccuugcuccguaugcaggacaugauucccgaaugaagacagcaggaaccaugugugguaugggguaaguggacagugguguuagccaaagacccgauggggugagggaggcaguggcucaagcccagggcucucuacuuacagccauuuagagggcccaggugacuagguuccuaccggucacacuacaggcugacagagcaaacuaaaagucagaggcagcccagacuccaaaaggcuucucuuaaggccaugggucucaaccuccuaacacugcgaccauuaaauacaguuccucguguuguggugaccccaccaucaccauaagauuauuuuguugcuacuuccuaacuguaauugugacacuguuaugcaucugagaaucuguuaugagcacuguuacgaagcugaggagagagagcagccgggucacucccgguuaggggagaaacaguugucugguuuccagggaagagggaaguaaggaugugggggaugggggguggggaugggggggaugagcaaagagacuucccaauagccucgaggaaugaggccuuauaaaaacagggcagagcugcuggucagacucucugaccuggcucucaccuccuggauaaugauccccagaagucacuuccccaaggccaucaaugacaucccagagacacccugcuccuugacagaaaggacccauugcuuaggcccugcccacccacucgggacgcagcagaagcacgcucucacagaagccagcucccuccgguucugcccuccccacagguagucccagacucggggugacagaauccuggcuggauucuuuguauggccucccucccugcccccccaccccuacucccccaccgacagcaaguccucuggacaaccauuuguucuuucuucccugagaaauuccuccuccuccccccuuacuuuggggagcggcuggcaacggcagaguggaaaaaugagugaggcuaaugguguagcaaugcggaggcccgagccaagaacacagccuugagcggcucggcugcccggggccucgcugauccggacacgugaguacccucacauucucucacaggcugagcacggcccucccuccccaccccaccccccuccgcuagcaagcaccuuucagaagcgcugguucuaccuccagggaggggaugcacaaugacguagggaaaccuggcaacagacuucauggaccuaaccccccaacccucgcuugaacaacaacaaagggggggggcaucauuuaacaccuuucauucuggaauccucuacuguccaguggguuagaaacaaacaaggucuuuucacaagaaauuuuacuggggguggaggguggccacggugugucccccaaaguguuccaagccagcuauguaaccuuacuccuuaggucacaccaacaagcaaaagcugccuggacuacagccugccugucagugauacacacugcauaccuagcuagacucccaggcagcuagguugaaauccacacccucuuggaccaguggcagcucaggaccccuaguggggugggcgugggagggcuaccagggagcuacagcugaggccagggccagauuuuggcagcacccccagccuuuccccauaggcacagguuuuuucggcagaacaaggacaaagccgggcuuugugguacacagcgggccugcagccugcagcuuuuccauuuaacguaaccucuccucccucauccugccaccagacuccuucaaaucugggugggugggaggagcuguaaaaccucagccauuaaaucucuuaugagaugcagguuucuguggacggaggaaagcauuucaaggcuggaagucucacacuggcuugcuccuuuagggugcucagggaacagggaagcagaggccgccauucccaacuacaaguggcccugcaaaguuuuggacguacccacucacugaugccucaaguccugcucucggagacaaauacaugcaagcagucuuccucagacuccuaaacuuuuggaagccgguauucugccccugggccugugucccaguuucauuuuacacacaaaccccaaaacccaaucugaagaaacaaagcuuaagacucgguaauauggcaaacgggagaaggacggggugggguggggugggagaggaggcugguuuuccuggaauccuuauuaaaucaacuuuguaaggacagccagaaacugcaggccuccugggucccuucagggcaggggcguuugcagaggacugccaggauugugcucagucaggggaggggcugccaucuccucgccgccuccccuaaagccuucccaagugcaagcaaagucugggaugauuuguuuuuaacuuguggaccaaucuuugucacauaaaguacaguuguuuuguauuguuuuguuuuuaaagacaauagcagcauuacuuaaucaucagcauggccaagacuacaguacacggcaugucugugagguuccaaaguuuacagggcauggacagggcauauuccucugacaucacaguuaauagugggucuguguucuuucaaaacugccccccccccacaacagggugugguggcauaagucuuuaauaccagcauucagaggcagaggcagaggcagaggcagaggcagaggcagguggaucucugaguucgaggccagccuggucuauauaauaagagccggggcauucagggcuacagagugagacuuugucacaaaaaaauagggaaggaaaugaaauaauacaguggcccacguggguaucacaggugauuagauucauacgucaucaugagacuucguccuugacaggaaauccucgaacaaacaucgcuaguguacggagacaggaagugacaggacagagguuggagacagcaagaagcaugggaaaggcuuuuggggugacacacugaucucucgacuaggaugguagcaacauaagguguaggccuuaugaaaacucacugagcugcacauuucauacuacauaaauuauccuucaaccaacugacuccagcuaugacuacuacacagacucuuccaccccuccccuccccuucuauucccagaaccacuacugugccuagguuucguggcacaaaccuuucaucccaggcagaucucugaguucgaggccagccuggucuacaaagcgaguuccagaacaagcaguacuacacacagagaccgugucucaaauaaacaaaaagaaaacagguaaaaaggucauagguccccugcuuuggucuccaccuuggcagcucagcagcuucaacgacccucccccuccacuuaaaauuccucacgugggggcagggagagagggcucaggguuaagagggcuggcuauauccgucaagaagacccagguucaauucugagcacgcacauggcagcucacaacugucuagaacuccaguuucaagggaucugacaccuucacacagaugcacacacgaacaagacaccaaugcacguaaaaaauuauuuaaaaaaauaaguaaaaagucauuuaaacuuucuuauaagaggaccauuuggaaacugccugccugcaagggccuggcaugagaucugaacugucugucugcuuuccuuccuugggcuguaaagaguuuguuagaggagaaaagguggaggaugagacuggaaaggaggaggaagaagagagaaaaggaccgggagggaagaggagcuggcguccgacuauuuagcaaaacccauggauucucuccuagaauucggccaucacucucccggggccucagucccacucccugacuugacacucaacgugcccuucuccagcccuuccugacagcagaugcaagaacagcuacgcacacuuucacguggaaguauugugucuguguugugacaucugagccuuuauuguuguucccauuuuagugguuugucgcacaaagcaaaccaaguuaccgaaaacugggucgugucuguacacuucaaauuucucggcaagaaccauuuaaauauacugaguuccuuagcaagauguaagaaagccuuccaugugccggcugaauccaguuuucccagguguuacucuccacagcuuuguacucagugagcaauaccacuguccacacaucuuaagccucucgacuaagaaugcccguucuuaucccccucagagaccuuaguacccucagguaagauuacagauaaacaccuguaauccagcacucaaaaggcugugguagaagaucgugcgacacagcaagauccuaugucaaaacuaaaaagauaaaacaccccuccucucuuuucucuguuuuuccuuuugagacagacucucucuauguggcacuggcacagaccaaaauggccucggacucagagauaugccuccgaguauugagauuaaaggcagguggcaccgcggacagcaggacagaugcaguucagcucuagguaugacaucccccugcauucugauaaaaccuuacuguacaguuuaacuauggucuacuaguggccaaagagauggcuuggaaguuaagagcauuugcuguucuugugcagggaaguggggucccagcacccacaaggcaacucacaaucauacuuuguuugcuuugcuuuauuuuguuuuuuuguuuuguuuuuguuuuuuuuuuuccugagacaggguuucucuguauagcccuggcuguccuggaacucacuuuguagaccaggcuggccucgaacucagaaaucugccugccucugccucccaagugcugggauuaaaggcgugcuccaccacgcccgcccggcuaaugcaugaucauucuuaacucccauuuccaaaggauccacgaacccucuuccgaucucugcaggcaccaagcauauacacauacucucaggcaagacacucagacacauacaauaaauaaguuuuaauaaguaaacagucugcuucauauuuauugucucuccauuguuugacgguaacuauauaccuauauauaccuauagcccuauagguacagagguccucucuugccuugagccuuaagcauguucuugcucauaucucucuuugguucuacuacugaaugcaccaugaauaugucaauuucagccaccgcacccugcuccucucucacugccauuuguauacacauucguaugcacagauucacucacugaucagcuaacaugucccugacagcuuagaggacagcccuguauacauggccaugguugccaugaacaucucaagccuuugacccauucuaugccagccuucugugaccagccacuaacucucgagccuuuugacaacagaaaggucucaacauuaaucuccaagucccucagaagccaccaggaaucuuaggagcaggaacaacuuucagggaaacacaccacaggccaguggggccucguaagacccccgauccccauccugccuccuguuccuuuccaagucccuuaaacaggccaucuccaaagcaaacuauccaucaggcccccagguaagaccuggaggacagaguccaaaaaggcacgugcucgugacugacugcucaggcccuuguagaagaucugucacuggaacggcuuucuggaagccagaggccacacugccaagcucuucuuacucuggaaugcuuucuccaaaucuauauucacgucacucuuucaucuuucaucaucugaguuaaagacccagaaagaaaguacuccccuagaaccucacuucuggcuagcgguccccauugagcccugccucugaugaagcugguuccggauauggaaggaagcccaaaucagcccagguauagggaaggggcccuugcuccuccaaagaggaagucuguccagcugacuacaucaccuccacaacaguuagcccacccugucuccucagcucagggguccagcugccccuccgccugucgucuuaccuuguucaggcaagguuggggcuggccuggcagugcagagaguggcugugaccagcacagcccagaagaggaggcacuuccagccccacaucccaguucugcgguuagagguugguaacaaggcuccguaccuccauggauauuccaccgugagcguggucugccuucgcaagcugacucuggggaaagaaacaacggcugaaauagacguuggagaggagaggggugauggggaaaaagagcgcaucgcaucccuggucaaccugccuggaaggcgguggcggcugcugcugcuucugcuucuuuaaauuaauuuauucuuuauauauuacauccugaccccgguuuccccuccccauccacuccucuguuucucuuccgaaaugggcaggcuucccagggauaucaaccagacaugacauaucacucgaugcaauucgacuaggcaccucggggcagaaagaugacucagcagucugaccgcucuuccauagguccugaguucaauucccagcaaccacauggcucacaaccaucuguaauaagcuccgauguccucuucuggugugucugaagacagcuacugugcacucauaacacacaaaauaaauaaauaaaucuuaaagacaacaacagcaacuaggcaccuccccucauauuaaggcuggacggggcaacccaguuaggaagacaaggguucccaaagcaggcaaaagcaucagaaacagccuccauucccucuguuaggaaucccacagaaacacaguuacacaacuguaacauucgcagagggcuuacguuagaccaugcaggcucccucauugucagcucagacucugagucccuaugagcccugguugaugcugugggguucuugaccucucuggcuccuacaaccccagaaggaugcuucuuaggguacaaagagaacugagccuauccugacaugaaucagggguaacaggucucaacugggcuuaaauccauaauauggcuuguuccccaauggguaccuuugagaggugaagagcccuuugagagacagcccuccugggaggguuuaagucagcuggggacaugcccuugaagaggauuacagcgauccagucuuacaccccucuccacccuuucuguuccuggccaugggugagcaggauuucucuacuacgaagagcuccaaggacuugccuucaucccaccacgaggcaugcucaaaagcaacagucaaccccagacugaaacccacaaaacggagaguuacagaaaccuuuacucucuuuaacuugauugcuucagcuauuuugugagagcguugggaagcuggguucuacccugcaguucuacaacaacguucucaguacagacuaagggccaaguuggcuaggacugccaccaugauguucuucgaaauaaaagccucgcucaucuaugaaaggaaaggaaaggaccucauggaagccccaaagagccauauugugaucaagagcuuaagaaagacauugugcaguuucaagucccaagcacuuccgaugcggguuaaguagacaaggccaaaaccaccacauucaagcagccccccgcccccaauggcacgaaaauggcaucaaaaaaugcagguaagaaaguuggguguggaggggcauuccuauagucccagcauuugggaggcagaggcauggggaucucugaguuugaggcccaccuagucuacauagaaaaguccaggacagccagggcuacacugagaaacugucucaaccccccacccccaccuccaaagaaaccggaaucacaaagauaugaaucucuuaagaugcaggcaagcaauacagaagcaacaagugcacacacugaggccauuaaaccccuucuaaagccuaaggagguugaaugacaaaaagccccauccacggggauaggcagacuugcuuuuaucacccacccaaguucggggauuggauucauggcugcacggcccaaggguugcagacuguaccaacuaaaggcuaugguccaagcaaggccaagacugcugcugcugcucagggucccauuggugucuaggccccagauagaccagugugacccaccuccuccucaaccccugccacacacacacacacacacacacacacacacgcacacacuauuuguagaugguugugguaacgugcaaauuaaaaauaaaaaacaaaacaauaacaagagagagaaaggaaggaaggaaggaaggaaggaaggaaggagaggggaggggaggggaggggaggggaggggaggggaggggaggggagaggagaggagaggagaggagaggagaggagaggagaggagaggagaggagaggagaggagagaagagaagagaagagaagagaagagaagagaagagaagagaagagaagagaaaaagagagagaaagagcgagccuuguuuaaguauuaugcaaccauuguaagggacaggaaucugcuaacuucccaacacgcgacuucauuccauccgggacaaaccaaucccucugauaaagaguaaauagagaggcgaaguguggggucacaagucaagacaccgaaggcgcuccagaccgucuuucaugggcaggugacuacuaaaggaaagaugaugcauauuguuaaucccugcauucugagagcaggcagaucucugugaguaaggcuagccuggucuacacagugagucccgggacagacagacagaaagagggagagagggagggaaaagaagagggaagaaagagagaaaggaagggaaagagggcguaagaaauaggagguuaaguacuaguucauagcuucaugucacauggaauauggagacuugauaaaccacuuuugugggggguggggggauagguuugaccagggauggaaucuagggccuuucacaggcuaagcaagugugcuacagcagagauccauccccagguccccagggucuuuuuuuuuuucuuuuuugccccuaaaaggagaagacucauaggaccuccagucccaccagccucccucccagggaacacaugcuucacccuugaaggcagagcaggacacugugcgacguuggguggugacgcuaacaucugacagccaggaauggccaugucagggugagugggagaggaaggcucuacggacaagcgcagucaagggccggugcagaggcugauugaggcaaaguagcucacacggaccugguuaaagccguggguucugcagcccuggagccguuucgaguuugugauggucauguuuugguauuguaaauguuuuucuuuuauggauuacugcuggggguggggggugggcagggugacugugccacagcacacaugcaaaggucagaggacaacuccacagagucagcucuuccccucuagagaccuuugcauggguuauggggacugagccgucucacuggcucugugaugguaaaauuuaaaggguccuaaggauaagaugacaaguggugagaacuggcuggccacugcggacuggggugaccaucuccuaucucccagguguuuucuguccucggugcuccagggaacuguccaagcuagucagagacucugcuuccggaacaugcccuaaugugguguuucagccuugccuguccuggaaccaagaagggccccucucuagccagucaaguccguccuggcuggcaaaaaaauaaaaaauaacaaccaaaaaaaccccaaauucuuggccagaagaauauaugcacacuaccauuagcuuccuccaaaggcuuacuuaaaaaaauuaauaauuuuaaacuaaaaaugaaguaaauauuucccuucuagcuucuuuuuccuuuucuuccuccuccuccuccugaauuuaggaaaaggguuagaaauggaaggaauauuugcugaauguucuguggagccuacacaaguaaaauacauuuauaacucuaaagcuuccuuuauucuuccuacucugccucuaaggagaguucuggucucugcuaagagaaggaaacugggauggggaaguggggagaucgggaacccaagagcuuaagaacuuugcccaaggaaauggagcuguugguaacacuagaacuugaucgcccagguuugggagacauuaauucaaggugggagaacgcaaauaacuucaccacaccuaaaugggauacagcucaggggagaaaucacugcccagcauacaagaggcccugaguucauccccaacacaggaaauucaaaaauaaaaaccagcccuccauccgaugugggcagacacaggcggauucccaugcgcuagagaaacuaagaggauaaagaggaauccaaguuaaugcugggaaacgacgacaagucccucauucucuguccacucagggccauucaggacccagggucaggcacagucucgggccugaagaugcucccaaagccguccuaaucaguguagauagccguuauccaagaaguacacuggacaacaaaacccugaaucccacaguaacccugaauacuaaguccuuaguaacaacaaaggauggguaggaggagcaggugucacccugagaugacugauuauacuccagcagaccgcagcuuccaccugucacucuguccccugagacaucugcccaccuaccucucccuaggugugggcuggcuguacacaccuucuuucauccccggugaugaaugcucuucagacaccugagacuauucugagaguagucuggcaccuucccccugacucauguccaaaacagguacaagagucccuccugccucccccucuucuacccucugggccucaaauugcacaacaaagaugcuauagacacucagucuccugguaccaacuccaggaaugaaaagguugucgggugcacucagugcacggcucacacaucugcagagugugcgguggcguaaaccacgaauccagacucgauggggaauccuaaagacgggccccguagcccuuaggaaucgccucuguccuccacugcuugacaggugugacccacagccagguguacacagagguuuccucacggugcuacgucugacaccccaucaguuaguucuuccacucucagcccaggcucccagauuccaacgcuuagaugaagagaucuucaaggaagggcauugagaucauauuaccucaguuuucauacuuguggcaaggcuaaaauaucuguccugaugacaucugggugguuauaaggaccaaauggacagugugaaagagacggagagggucucuuuuaaauaacuuacacaacaggagcuucaguauaucuagcgggaagucagccuggagcacccggccuuguaccucaacucuaaaggacuagagagucuauuaacaucggaucucuuugucuaaaaugaugcacgaaaccuacuggcuggugcuuucagggccaaguauuggucauggucucuucuucucccucaucuuccucucuuuuucuuuugguuuucuugagacaggguuucucuguguaguccgggcuauccgguaacucacucuguagaucuggcugcucucgaacucaagagaagcaacugccucugccucccaagugcuaggguccacacuugccugccucugccuccuaagugcuaggguccacacccgccuucucaucuuccuccuaaacauuuucuuugugcaugcucgugugcacguguaugugugugugcauguguguugcgacuguguauauggguacccaaggagucaaggagagagggcaucauagccccugguauaaagugguaugagcuacuugauguugguccugggaaaugaacccuggucuuccugagggacagugugugcucuuaacagcugagccauugcuucagccccuaguucuccaucucccuguucucuagaaggcagucaacaaacacuuuuauccaggacacugacccacgggacaguuccuuaacaugggcauugguucccagcugaaggagaccugaacauuugucuucccacaucacaggugguuacauguauacauguucacguauguacgcauggcaagcacagugaagugccuucucucuauaauacuaggcuaacagaagaaagaaucguaagcuuguauuuuaaaaaaauuacuuuuaaacuuauuuucuuuuauguauauagcuguuuugccugcuuguacgucuguguaucccccgugugugccuuuagagaacagaagagagcauccgauccugcugaaacuggaauuacagauugugagccucaccaugugggggugcugggaaccaagcccagauucucggaaagagcagccaaugcucuuaaccacugagccgucucuccagaccccaaacuccuuguauucugagucucuccuggaccacacuccccuacagaacacgagcuuccucgcuucgcacagguacuucccacccuccagccucacagcccuaacacucuagaccuaguuggcaaaucugguggcuccaggccacacugcagcuguugagcuauugaaauaugguccuugccaacuggggugaaugagagugaaaaacagaauucggccaucaacacagggaaaaaaaaaacguaaaauaucuuaaccauuuuuuuuuuaaaauauugggaccagauacaguguguacucugucaugcuugaagcuguugguucaacugaacugccagcacuuccgaauuuucauauugauuccauguaaaaggauauuuuagaaauagcaauaauaucauauaaauagaccugcuauaaauacaauguauucuuaaaaaucuaaacaaauacauuuaaaguggauuucaccuguuucuucucauagacuuaaggaggcucccauuguauuugggggucugagucagugucccucuugcaacuagauccccacaauuaggucacaaagcucugcuuccagaggccuucuagcucuucagcccaguccucugauuuccguauaaaucaccagccccugucccagggugccuaggucaucagcuuacugcucauguuccucaugucccccuuucuucucuccccaggcagccuggcuaguuuuaugucaacuugacacaaccuagucauuuuggaagagggaaccucaacugagaaaaaugccccaccagcguggccugucugcaagccuacagaggauuugcuucauuggugauugaugugggcaggcccagcucacuguguacagugccaccccugggugggugguccugggagcuagaagaaagcaggcaaagcaggccauggggagcaagccaguuagcugcaccccucuguggcuccaucagucccugguucccucagcaaugggcaguaaccuggaaggguaagaugaaaucaacccauucuuccccaaguugcuuuuggucauggugcuucaucucagcaacagaagcaauaggaacucuaagacacuggaaaacacuggaaaaaucuaugggcuuccaugaagcaggauuggugccuaccugccuuucauccuacccucagaaugggagguggggauauacacaggagauggagcauccauguuagagugggauaaaaggcaagcgagccuagaagaaacaaacccagacccaggacccucuuugggaaaugucuggaaccuuccacggaucagauuuagaaguuguuuggauuucggaacauuuggauaggcuuugccaguaagcccccaagugugagaucccaaauaucuuggagucuucuuugacugccaacaggacaugugcuucuggagucaaggcucucaacccgcauauauccaaggaaaaaggagagacuuugagcaggggagccacaggcaguuccccaugcuaacuacccacaauaccaaagaggaauguucuaaacauacugagggcccagauuugaggacuaugguacagaaguaugacucccuuuagguaaaaauaaaagguacuaaacaauagagggaacuuuccacucacagcgcuuuuaauaaacauuuuuaaacacuaggggaagcuuugcucacaaaauugacacuggaacaaaagaaaugcuaaauuguggagcugcagcucucucacccucgcuggcugaagaccaucacugggucuagugaguucaguucugaguuugguggcacaaguucacacucgcacacagacauauacauauagauaaaaauaauaaaauaaaauaaaaagaaaugcaaugcuugcauguuuuaugaagaaguucgguuuauuaaaaauauuuuaagcaacgaggguuaaaagaaggaaaugggcuuucugaaagaaagacacacccaagagugaggacgaggguuucucuauagagaguggccuagcugauuuugcaucucuguuacaaaguauccacauagaaaaaaguuuaguaguaaacuuuuugccuagcaguaaaacuauuugccuagcaagugcaauauacccugggugagccccaacacuacugaaacaaaacaaaacaaaggagagagagagagagagagagagagagagagagagagagacguguuugcauauguaaaaauuaucuaaaugucuuuuauauuaaaaaauuaguaauuguaugggggcaugaagccugucuaccaccucacacucaggaggcuccagcaggaguaucucaagcugcuggccuugagggcuaugaaaaccagacucaaaaaaaaaaaaaaaaccaaacaaacaaacaaacaaacagggacuggagagauggcucagcagauagaaguaccugcugcucuuaaagagacuaacugggucuagucccuagcagcaccaggugucucgaaaccauuuguaacucuaguuucaggggaccuaacaccacccccuucuaaaugcaucaggggucagaaaugcgugugauccgcauacauacauguagaccuaaaucuaaaaaacaaacaaacaguaacaagaacacagcgagugaaacaacggcuuagcugcugaagacaggacauaacacagguguccaguguuaccaguguaaucuuggaauuccuuacucgggugaacauuauuuaaauuuccaggcuugggggcugggggacuggggcuucuucuuggaggaaugguaguaagcuaagaauuucuauuuaaggccaaugcaaacuugggguggggugugugugugugugaauuagggguggggggcaauauccuaagucauaugaggcacuuaaucccucccucuggaaacaccagcaccuuuucuaaaguuccacaccuggccuccucccggugcauucagacccuuuccagaacccuggagaaggggagacuugcaauacaaauuucccaagaggaaaugaaacuccucccaagugacaggaguguggccuuuucacaagacaucacaguccauccaaacugcucuuccuccuguagcucaggcccagacuuuccaggaaggaaacaaggucgucaggagguccaagccagcuucaaacucagcaugcaggaugaccuugaacuggggcuccucagacuucuacccagaggcacggaggucaucaagaugacagguguuacccuucaacagccauuuugaucaaagagauuacaaaaauuggagcaagaaaagagccuuuggggccagcaagauagcucagcagguaaagaaggggagggauugcagcuaaacuugaucucuuagauccaacccacauagugggagaaaaccaaauuccuuuuuauuuuauuuuacacauauaugguguguguggauaugugcaugccagugcaggugucuucagagacaguaccuuuccugugaacugccugaggugcaugcugggaauugaaccugcguccucuggaagagcagccagugcucuuaacggcugagccaucucuccagccagaggaaccacuuccugcaaccuauucucugaucuccacuggagcacuggggugcccacauaaauagaugaguagauaaaugugauuuuaauaaggaaaaaaaaaaugaacgugaaauaaaaaaaacauucagagacacuaguugcuaaggcccaaguuucuuucuuucuuucuuucuuucuuucuuucuuucuuucuuuuuucuggaacaagcuuuuaagagccgugcaugggguaaguaucacaaauaagcaaagagaggauggcuaucagugcacuccguggauugucuuggucuccaagguuggugucuugccuacgcaaugcuccauucaauucccucaucuggaguccacucugaagucagcuagcugggguuuaggguggcaauauguauucuaauaggugagaagauggugauaagugugccgcuccucuguuucuucagccccucggcuucacuugcuauucaaaggacacugacuuaaccuuccaccauugcuucacggccuggggccaaggaaaacaacccucucaagacuauauaccauggggccaaaggaagcaguuccuccaaccucccauugugaaugaaaauaccccugaaacucauauuggaaauacacacggcucucaauccacugcuccucacugaaaagcugacguucagcuaugacuaaggguaaacgcaacauauuuuaaguagcuugucacugaugaaguguguaacuguuccggcuggaaccgagccccagacagcaacucaggguccccaaacacccagcacucuggggucaucuggguccccagagugugucccaacuggggaaauauguaaacaagccauuagggagggaggcaagccaucagcacaguugacggguauuagucgagcugagccguuggccuuaggucacugaaaggaagagacaccaccccagcguggggguaauuggcuagaccuuggcaggucccaggggccagcuacuuagcuuuaaaagaagccccagagaggaggaaacccagagccuggccaagggaggaagacuggccacuuuuugcucaaccaucucagggcaaugguucuacaauuuagauacuauuccaaaaaaagcaaugguccggaggugcaaagaccagagcacaucugggaaggaaacagucaccuuaauuaccaugucuagggaaagugcgauuucauuacagccuccaaaacuaccgcccuaagaaggaaaccagagaaguguuuucaauuuaaaagacuggagagggugagaggcaccggcaaacuauacccacccagccgcuaacuuuggauggacccuuaggauguuuuguugccccccccccuuccaaaagaauggacauuccaucccuggcccuguaguuauuguuuaaacggcaaaaacacuccauuuuaagcuucugagggcugcaacccaggaaacucacugaaaacacaaggucccucuggcaguuacagcaccagguaucgcacucuacuccccaaauggaggacggaacacccccccccaagauggacuuggacgcguggcgauaggugggcccgcgguguccacaugagacagaugcuccaacuauaauuaaagggagaggcgauacuugguuccaggacacgucagggccaaguuuggcccagacccaccgaccaaggccaccucuaguaagcaagcggcucccaagaggguccagagauucuuaaacaccgccccccccccgcacuccccccccccccaucgucggccaccagcaagagagugaaggaauccaaaaucacuuugggaucuauaacuugcuuuucucuuccaaucccaaagccucugcuccacgucucaagaaauguuaagggguggugguggcgguggugcuaaagaaucucaguuuuaauuuaggagggggaggggaggaagagggauguuuaauaauguggcugcgguguacccguguagggugaaacggaaccagaugcggcagcuacaucugggaaaugggggguggggugggggagaaaaacgccgucgaaaugcuuugcaaaugaguuaauagcuucuacuaggcccagagaaagagaacucccuccugcacucccaagguguccagcugccucacuggguggguaacuguuuauuacaaaccccaucuauauauuuaaaaagucaguaaauuccucuaaaaauaugaguacuagguugucuuaccccgccggagacacuacaagaggaggcacaggagguguggagagggggucugggccagagaagcaacaagcgggcagaagagggcuccuccgcaccggacaaguucuccucauuuccuccacuucccagaacgauccagaccccgagaccccccaccccccgcuucuccagaccccuucaagaguccucuaggucuaagauaaaauagaacauuaccaccaccaccaccaucaccccucaaaaggggggggaaucuuugcucgcucuccgcuaaagccgauucagccauuuggugacgacaccuccuucaaaccuauuccaagacaagcuagccuuccccgccacuuccuuuccucuucaaccccccaaccuggaccccagacuugcccggagguaggaaaacacuugaaaagaucccagauguaggguguugagcuuaaagccaccggcugaaacggggugaauccgcaagaggaccaaaagauagaugauguacacacacacacacacacacacacacccuccaucucccggcccauucccgcccuccuccccaguagggaacacacagcuuccgccgccuucuccugggccaagagggucggggucuggacucggagcgcagcagccuccucgcuagcuccggagcgcgaguuggcggaaaaguuaggcagcgggcagcagcagcgggcccagcgcgcggggagggggcgcgggcagcgacacuggccgagggaggagggacaggggcgccggggagggagcggagucggggguggggugggggauuggaggagggaggcgcgggcugcgacuggcgaagcgcgggggccgcucgggacgcccagccagccggcucugcgggcgccggcgacucuuaccucacuuggcgcugcggucccgccucuggagagcucgccguggcgcggcgggugucugugucuugcgcucccgccgcucgucuccgggcuccguucagauccugauggggucucgagggcuccgcggccgaggcacgacucccggcggcacuccgagccgggcgccuccagcccgggcgggaacaauggagccgaagcuggugccccggaggcggggcgggggggagggcucggguccgccgcccgggguccccagaucgugcgccccccgcucuccaguacgcagcggcggcgguggcggcgucucaggcuucuggcagcccgaguuccaucaccccuccuggggcuccggcgugcauugacugcagcacggcuguggugcgccccugggaccugagaaaaguccucggucuccgcugcuuuuccagcugcggcgcgcgcucgcggccgggaaaggcgaggucgccgcaaugcgcuaagcacagucucaguccaguccggacgucucggccccgcuucccugcgcagcccggguccucugcacgcagcggcugcaccaggguuccggcucccguuccgcgccgcccgcagcggagagccccgccaaaguacccgcaggagcgcuccgagcgcugugcgccggcgaggcgcgagggcuc

SEQ ID NO: 12142 - RNA, 18386 nt, Mus musculus
cggccgguucccguccgcgucccgccgacgggcgacuggacgcccucgcggccguccggugcagccuugcgagagcucaaacaugaacuauaugcccggcaccgccagccucaucgaggacaucgacagugaguaccuaaccucucccucgggggaagccuggugugggaccccuuuucgagugggcgucccucgacaagggcccagagagugaucucugggcccgggcggggugguucugccuucacagccucggacggagccuuuucccaagcugccuucucuguccuugagcggguaacaccuccccgccccccgccccccaagcugugaaacgccuuccgaggggcgcagcauccgacuugggaacgugaagggcagagcacgcgaaggaagucgccugagccacuucgcguucccaagucggaugcugcgccccucguaaggcguuugacagugaauggauggagauugcuucuagaaaggacucaccagacccgacaacagcaguugaauuuaauuagcagagaacguaggcuuucuguuguauagccacuagcacucuccuuuuucuguaagggucauuagcacuuucagauuaaaguuguagagacaggugccggacguaauaacgggauuuucugcgaaugcuaagucacuucaaacuuacucuuuucuguuugacaguuuugcuuuuacuaaaaggagguuaguccuguaaaaauaaagagguuacaauuucgguuuuaaaagguuuaauuuauuguguauuuaugucucgucuacauguaauuaaaccacgggcauauugguauccacgaagccagaugacuuucucuucuugggauccucuggaauuggaguuauggaccgaguuacagagucacagugugggugcugagaaaggaacucagaucuucugcaagagcaacacgugcucuucugaaccaucucuccagccuccacuuucauucccccgccccgaauucuuaccuguguaugauuccuugaauauaacuuuuuuuuuuuuuugguuuuucgagacaggguuucucuguauagcccuggcugaucuggaacucaccuuguacaccaggcuggccuggaacucagaaaucuuccugccuuugccucccaagugcugggaugaauauaacuuuuaaagcagcauuaaaaaaacaaacaaacaaacaaaaaaaaaaaaccgcuguauaugagcauguauguaugugcauugcgagcuugccuggugcuggagagaacagaagaggguacuggguccucuggaagaccagacaauacucuuuagcacugagccaucucucaggucuauaaucagcauuuuaaaaucauuuuaauacugugacuuuucaaaagcaaaaugauuuacaacuucaaacaaguaaaaauguuuugugugaguuugcaaauuagagagcagcugugauuauauagacugggauaaacauauuaaaguuugcucauauauuacagguauagauauuaauauauauuuauauguguauuauagcugcauacacauauacacuacuuuauaagccuaucuaugaagugugaugaaauacucuuaguggaacuuuuugccuucaccuuuccuuagauacgugaauuaccgaagcuucuaacaacaagucugcuaucuuacuaaacgcgcuuguguucucaagccuucuuggacuuuguggaucucagacccuuucauuugauauacaaccuuuagaacgugucugucccagucuuuauggggccuuuugguuuuuucgaguuguuuuuguuguuauugcuuguuuuuguuuuguuuguucuuggguugagacaggaucucuccaugauccuggcuauccuagaaugccccugccucugcucucccuugcucugauuuaagauaggugccaucaugccugguucagcuaugcuugagucuucuagcucagauauagcucaguggugugucuccaucagacucgcaucccuuccugaguaccccagugcacugcagcuuugacucugcugaccaucuuugucuagauuuugcugucagaagcuuugggguuuuguucuuuuuuuuuuuauugguuugguucauuuuugaaagggcagccaccaggcuggccccuuuaaaucauagcauuccuucugucucuguuuguaaaauucugggguuacuguguauugguggcucaaaucccaguacucaggaggcaaaggcaggcagaucacugugaguuccaggccagccuggucuacgaagugaguuccaggacaaccagagcuguuacacagauaagccuugucuccaaaaacaaacaaacaaaaauucugggguuaaagacaugggccaccuugccuagcuuuggcuugaagauauguauauauauauaaauuuuuuuaaagauguauuuaguaucuauaaguaucuuguagcugucuucagacacaucaaaagagggcaccagaucucauuacagaugguugugagccaccaugugguugcugagaauugaacucaggaccucuggaaaagcagacagugcucuuaaccgcugagccaucuccagcccaaagguguaauauuuuuaaagauuuauuuauauucauguguaucuuuuuuccuaugaauuuuuagagauuauuuacuuacuguuuauauguuugugccuacaugaauaaugaauuuauaugaagugcaugugugcaggaugcagaaggagggccuggauauggaguuaaaaagagccaccucaugguguauaagagaagcaguguucuucacuguugagccaguuuucuagccccucgccccucgaagcuguauucauaguuauaaauauaaggccuuccuuuuaagugcagcuguacauuguguuguguguuuggguuuuucaaaagguuuauuuagguauuuauauuuauguguacauguguguaccuguaugcuuacauggauuauguucaugcaggaacugacaucagguagugugagcugggaagugagccuggguccccuagaagagcaguaagugcucuuagccaccaagccauagaaccugcccucuguuuucuugguuucuccaacucuaguucuugaggauuuucuuaguucucuagacuuuacuguucucuaaacuaggugucugaguugcauguuggguuuguuuucucuacaucucuagacauucuaguugggcuuagcaucguaacuuccaaucuuucuuucuuucuuucuuucuuucuuuuuuuuuuuuuuuuuuugauucaauaaaguuuucuuuucccaaauguacagcugauuuaccuguucaugcaccuuccccagcagccggagcgucuccacucuuuguguuucugguguaaaugacuugggcucugugcuuugaaaccagcuugauaaguccuucacuaaggagcuccuggagggcuguccuggccaagggaaccucgaaucugaauucagucuuuccggagaucacagcuggaguaauaagcuugucguauguggcuuugucaaacaggacaagauuguucaacuuguucugaacucagccuuuggaccacuucuucuucuuggccuugccaccagauuuauuuacugggucuuuguccuuuuuggccgucuuuccggcaucuuucuucuucuugucgucuuugggcggcauggcgaagcucagagagucgugugaaucacugcagccucacuaagaugucggaaaaaagccaauuuuucuauacaucagucuuucaugcuuccucauucuuuugaaguuaaaccugccuucaauacuugucagaauuuagcuccuguucuuucuuuuaacuuugagccgaaugugaacaugcuacuuccccuuauacuuaauuuacagauucucuaaucuuuuguuuccacuuucucuuucucauagccaagauuuauuuauccuuaaggauccaacugggauaggucuaguuucuuuuuuaagucuuacauaauuaagauuugcaugcuuaugauacuuaauuauagcuaaugaugacauaacuccuuuagaggagacucauugcccuucuuuucagacagacagugcuuuaugcugggcacugguggcacacaccuuuaaucccagcauucagcaaagguaggcgauaagugaguuugggcccaaccuggucuacagagugaguuccagggcagccaggucuauauagagaaacccuggggggaagggcauucacugccacaccuggcuugguguaugcgcuuuauuuuugagcggggcauaaugaagcacauuaugugucuccuaagugcauuaauccuagcacuuaggagacagagacagagguagauagaucucugugaguucaaggccagccuaguuuauaguuucaggacagccagagcuauacagugagacccugucuuaaaaagaaaaaaacagggguuggggauuuaguucagugguagagcgcuugccuagcaagcacaaggcccugaguucgguccucagcuccggaaaaagaaaaaaaggaaaaaaaagaaaaaagaaaagaaaaaaacaaggcuagugagauggugcagugaguaagagcacugacugcucuuccgaagguccugaguucaaaucccagcaaccauaugguaaugagaucugacucccucuuuaggagugucugaagacagcuacaguguacuuagauauaauaaauaaauaaaucuuuuaaaaagaaaaaaacccaaaaguacuuuaugcauagcauuaaagaaaugacugguugaaaucuugcuuuucuuuuuuuuuccccaccucuccuuugcuugcuuuucuaaacgaugcuuaucacacuucagagucccccacaucacacuuucugugguuguuuugguguguccuucauccaacuguuuuguuauucuguuguauuuuuuguaagauguaauuuuuuugcuuucauccuacagugaauauaaauucaugagguuggugacuuugagaccucagaauaguuuagagcaaugguccucaaccuuccucauucaacaacgcuuuaauacaguuccucauguugugacccucuaccauaaauuuauuuuuguuacuacaucauaacuguaacuuuguaggccguaguggcacauaccuuaauccucacacuugagaggcagaagcagguggaucuuugaguucaaggacagccuggucuacagagcuaguuccagaacagccacaacuaaaaacaaagaaaacguguuucaaaaaaccaaaagaagaaaaaacaagcuugguggggccaugaaucuuucacacacacacacacacacacacacaagaaaacaaaaccaagaacuaacuuuacuaguguuauaaauuguaaauaucugauaucugauaggcaaccucugugaaaggguugucugaucuuaaagggguugcuaccccccagguugagaaccgcugguuuagagcguucaauaaauguuuaauucagucuaaugagacugcucagugguuacauaugcagacuucuuucucuuccugaagaccagcgugauuuccagcacccauguccgugguucccugagaacuguuuguaacuccacuucuaaggagucugaugccaacuucuggucucuccaagcaugugcgcagacaaacacaacacauaauuuuuuuaaagcuuuuacuugaguuccuguucuaggucucuaucacaucuugccugucugagacguuucugaauuuuaguuuuggugcugggcauugagccuaggguuuaggggcuuuacuucucagcuacacacccagccagccccucuaaagcaggguuuucauuucagauuuccuugauugaaugaaaauguugaaauaauucuaggauuaagguaauagaaauuuagccaacgaugaaaguaacuagaacuuccauaaucccagaauuuagauggaggcaaggcauuuaagaguucaaggcugggggcuggagagcuggcucagcaguuaagagcacugacugcucuuccagagguccuggguucaauucccagcaaccacaugguggcucacaaccaucuguaaugggaucugaugcccuucuucuggugugucugaagacagcuacaguguacuccuauguauaaacuacaucuuuuuuuuaaaaaggagggaggggcuucuagguuauccuaaauaugagcuccacuagguuaguaaaacccucucagaaaaauaaaagccaucuagacuaagcuucucuauuuaagguagagaaauuauaugaugcuaaaaggguugacuguaacaucagggccagaaccacuugcuuuccuggcuacucaguguccuuuucuagcucaacagcacuaacugcuccaagucucugcaguacugaugucauuuaaaucccaggcuacagucuuccaucccguguuuuacaccgagcuccauacuaaauacauuagaagagggucugguacagcuuagacaacuauuaacugaauuuuuauugauacuguauaaguucacugaaacugacaccuuuguuuuaauagaucuuuucuccuuuucccagaaaagcacuugguccuacuucgagauggaagaacacuuauagguuuuuuaagaagcauugaucaauuugguauguauugguuaugaucccaaaaaauuuuuuugcacugcuucauacugaaauuuacuuaucuaacuuuuccacauguaucagccuaauggaaguguuggggugaguaauuuuuuuuuuuuuuuuggcuuuugguuuuucgagacaggguuucucuguguagcccuggcuguccucgaacucagaaauccaccugccucugccucccaagugcugggauuaaaggcaugcgccacgaguaaauuguuuuagaguuaugauuagguguuucaaaaccuuguauguucauucacaaaacaaguuuguauucuaaaacugauuuacacuuauuuuccccacuagagggcgccaggugacagguuuaaaguuagucuuaaaaucauuuccuggagguaauccuucccuguccagugagaauagggucgaggccauuucccgaaacucuuguugggggcagaacacagauaaacucaguaguuuacauacaggaauacaucagauuuagucaucugucugcacuuucugaaggaagagaucuguuucucccuuugguguaagaaaccucuccguucacaccgacacuugcuggucaucugcuggguuccuggauuugaaugugagggcaaacauaggaggccuaaacagccagcugugcgccugggucccagggacuuacggguagaucaagagggucacuuuggaaacagaucaaaccaaagcaaaacaacuucuguuuuacuucaaggaagacaaauaguacuaauucaaaggagaaaaagauuuuuaagaagaaaauguucuaaaccuuaaguuaaauucauguaagugcuaugaagagauaaaaagcaaauuccuagauuaccaugcaugauuauauaaaucguuguuguguccuaacccauaaaauuuaguuuggauuacaugaguccuaauuacuaaaaacuauuaaaucucacuaaagucaucacauacauauauucacacaguaaggaagcucuccuucuaaaaaugcagacuuucaaucuuaauaguuggcuaggcucuaguuuuccagcuucccacucauuuauauuuccuagggaccauguugauacuggcaggaaaugauacagaaguaacuuauuccuaccaucaguuguucauuagcacagcagagucggaaaugcucuuuacuuguuugaaagucuccuaaaacugaacaugccuguagucucagcguguauagcaugugaagcaggagaaucaccacaaaugcuacaucaggacuuccaggccagcugaggcuagagugggacccugggacccugccccccccacccccaaauaaaacaaauucucauauauggcuugucauaacugauaaaauuuuaaaaauaacuaaauaauuuaguuauagacuuuauaaucaacaaugucaacuaaagaucuguuucuucuuugugugcuuauagcuaacuuagugcuccaucagacuguggagcgaauucaugugggcaaaaaguacggugauauuccucgagggauuuucguggucagaggagagaaugugguccuacuaggagaaauaguaagugagacuguuaaacugcugugcgucuggguauugauguuggcugcugcuuuccaauuuaccaagcuucccacaggaagcuggcaacuagggaagcugugguugccagagcaacacuacagaaaguaauuaauguuagucugugaccuuuggcauuuuaaagauuugauuucacucgcaaaauauuguugacuuugucggauagaaaacaauauugcugguguuugcuucaauagcacuuauacuaagguccaaacaguacaaagauuaacauggccugugcaaggguggcacacauucucucaacuggaaagaaagagacagcauugcuagguaugguggcacaugucuaaaaucccagcaguuaggaagcugugguagguggaacuccucuaguuugaaacugucuuaguuaggguuuuacugcugugaacagacaccacaacucuuauaaagggcaacauuuaauuggggcuggcuuacagguucagaggcucaguccauuguuaucauggugggaagcauggcaccuugcaggcaggcacggugcuggagaugcuaaaaguugugcaucuuguuccaaaggucagcagcagaagacuggccuccaggcagcuaggcugagaguauugaagcccaucugccaacaaggccacaccuucaaauagugccacucccuggcccucauaggcuugucaaacaugagucugcauuauagcauaaugcaaaacacauuuaguccaacuuucagagccccccauaguauauugcagucucaacaauuaaaaguccaaaguucaaagucuuaugagauucauucaaucacuuaaagucaaagcagaucacacaccuaaaacaucacaggauauacacuaccguuccaaaaugucauagugaguaaaugcuagaacaaauacaaccaaaucccagcugggcaaacuccaaacucugcaucuccauggcuguugucaaagcacucuucagacuuccaacuccuuucaucuuuguuuacugcagcacaauucucuuuggcugguuccacucccuguuggcaucuuuccucagcagguaucccacagcucuggcaucuugaaaaucuuacggucuguaaggcaacuucagcauuacagcuucuuguucuaaugucugggguccacacaugaucuucuagguuucacaaaagggcuugggucacuucuccagcuccgcccucuguagcacucuaagcucagguugcuccacuccacugcugcugcuguucuuggugaucaucccauaguacuggggucuucuggugcaacuaggcuucaccaguacugucucauaggcucucuucaugguaccaagcuucaacuucuuugcaugacuccuucaguccugagcugucaacuacaacugaggcuccaccuuuguuaauaaccuuccaggcccuugcacaguaccaagccucagcugcucuccaugacccccucauaccuucaaaaccaguaccaccuggaugacucuuacacauuaccaaguccugcugcagcacaagguacaacauuggcucucucuggaacacagcuucuuugugcccucagaaaauacuucccagauuucaccucaguaaugcuggucucuucuuaaucaccacuauauucuuagcuccagcuaaccagcaucaauugucucaguagucccuucuauuuuuggcucuaaagccagagccacaugaccaaaacugccuugcaggagcuggaacauggcccccuuguucuauuacauuaucaacagcuuucuguuuuccaacucuuucucucccuaaggcauagcuguccuggaacuugcuuuguagauugagaccuugaauucacaucugcauggcccugucuccugaaugcugacaucaaaggcauguaccaccaugccuggauuuaagcuuuucucuacuuggaacuuguucuauaccaggcuggccuugaacucagaucugcuugccuuaggcuccugggauuaaagguguguauuaccaugcucaggccuaaauuuagcuaugugggacuuaggcccaaagucacaacucccuuaaucuguucaucgucuugaacauaggauacagcuccauuucacuuccuaguaccccuuuauuacuugaaucauacauuuuauauuuuuccuuucucaacuuguuccuuuucauuaaaaugcuuuuuauaagaggagugaacuuaaguaaccacacagcagaauuuguacugggcuguuuugagacuuccuuugucaaagcaagaaaucuaaauuuugucaccuuagccuuaggcagacucuucagauaauggcaaaaaguagccacauucuuuuuuuuuuuuuaagauuuauuuauuauuauauguaaguacauuguagcugacuucagacauaucagaagagggcaucagaucucauuacgggugguugugagccaccaugugguugcugagauuugaacugaggaccuucagaagagcagucaguucucuuacccgcugagccaucucgccagccccagcagccacauucuuuaccaaaauaucacaaaaacggucuuuaggccacauacuaacauucuucuccauugaaaucucuugggccagguccucacaauucaaaucacucucaguaacaaagucuuccauacuccuacuaggauagcccaauaaguccuauuuaaagcauuacacuguuuucuaaacccaaaguccccaaaucuuccaaacaaaagcauggucaggcuuaucacagcuauaccccagacccugguaccaacuucugucuuauuaggguuuuacuacugugaacagacaccaugaccaaggcaacucuuauaaaggacauuuaauuggggcuggcuaacagguucaguguaggcuuagauuuuucaaauccuacuuuuaauaaggguucuuaaaugcuuuaaccuuccuucuaacccaccauucaccagagguagugggaaagaaagguuauuaagacgugggggguugugaaaagcguaccuguuuggaaauaguucuuuggaacaaauccaguuugcacugucaggauauauacuagaaguccaguucaguggugucagaauagcaaacacaaaucagcaguguagcacaaaacagccaggcuucccucugccgaauaggcaccagucaggaccagcaaggacaccaggaguucucugccaugccucucucaacgaaguggagaucagcgaugacaaagacucaagaccgaggaagugcugccaagguagcuaugcaagcucccagucacugucugcugaguccuguuuauacuccucccacgggucuucccucagugaaacacuaaacaagucuggaucagcugacaucacucugccaauggcgagaaacugccagaacaccaccgcaaguuuuuuagucaguuuuuccuaugaauucaagacaaaugaugaccauuaaggaauggcaagacgucccaauaccguccaucgucgucccccaucuguuagguuauauuuaccuuccuucuuaacaucauguguccuuucacaugucugcuuuaacaaaacauccuuucaucugugucugcuucagugaaacacuccuucacaugucugucccggcaaaacaccauuugacauaacucacucuccaaagaaacuagaaguuuccacuucagagguucagugcauugucaucaaggcaggagcgugguagcaucuaagcaggcauggugcaggaagagcugagaguucuacgucuuguuccaaaggcggacaggagaagaccagcugggaugaggguccuaaagcccaugcucacagugacacaccuccaaauagugccacucucugggccaggcauacucaauccacugccgaggcuaugauaugcuacauagugaguuugaggccagccugagcuccaauauaaucuguguuucaaaagaaaaaaaaaaaaaaaaaaaaacaagaauaacauagucauguaguguuuaaccucaaaugcagaaaguuacagaauuuaaauuaccuguccugacauauaaagguacaguuuaggggcugcugagauggcuuaguggguaagagcacacugacuguucuuccgaagguccugaguucaaaucccagcaugguaaugagaucugacgcccucuucuggugugucugaagacaacaacagaagacaacaacaguguacuuauuuauaauaauaaauaaaucucuuuuuuuaaaaaaaagguacaguuuagagcuggagucuaucacaguaguaaaguccuuaaugcaaccgaaaacaacagauuuacauguugaaauauguuaauuuaaauaacugguuaggaacuuggagcgauggcucaggaguuaggagcacauacuguucucacugaggaccugaguuugguucccaucucacaacugccuauaacucagucuccaggggaucccagggcaccugugucaaaugcauauaccacccccacauguacauaauuuaaaaaguaaaauuaaauuguacguuacaaguaggucuucauggcauggaguuaauuggcagcauuugaggaaaguguuguauguguuuuuaaaggggaaaaaacagaaacagguuagaaaaagccauucugagauuucagaguggagcuuaugaccagagagaagggacaugaauauuugugccagaaagaccagauauuaaaugaaauguuaaucacauuuguugaaauacugcuugcuauguauuuguaugcauacauaauagaaguugauuauauguauacauacauguguguuacauagauaacuuuuuauucauauuuucuuaaguauauuuaaaccuugaauccuauuggguuugcuaggaaaaucaaaauacccgugagacuggcugaaauuaaugggcaggaggaguugguuugcucaguagcaguauacuugggugucacgucuggaacccugaauuuaauccucagcaccacaaaagaagagagggaaggaagaagaaauuaaagacugacuuauguuggaaacagucagcuuacucgcagcugucuggugacuuucagcucagccuggacugucuccagcacacugggcuaggcagauggcuugcuggguaaauguuugcugcacagucaugagagccugaguuggcuccccagcacugggaggugaaaacagacagauucugugaucucagaggccagccagucaagcacacaccaagaguuccagguuccuugagagacugucucaaaaaauccgauagagagguaaagacgcccuaugucagccuuuacuuguacaugcacguaagcgcccuucucaaacaaaguguauucauaccucagcuuaaaauaguuugugguagagcuagaaagauggcuuagcaguuaagagcaugugcucuugcaaagaaccuggguuauccucccagaagccacaugguggcuuacagucaucuguaacuuaaguuuugagggcgcugaugccuucaguagguacuaggcaugaacacagugcacauauucauucuuuuuuuaaaaggauaauuauggaagggaucugcaacccuauagguggaacagcauuaugaacuaaccaguacccccagagcucgugucucuagcugcauauguagcaaaagauggccuagucggccaucacugggaagagaggccccuugguauugcaaacuuuauaugccccaguacaggggaaugccagggccaagaagugggagaggguggguaggggagcagggcugggggaggguauaggggacuuuugggauagcauuugaaauguaaaugaaggagauaucuaauaaaaaaauauuuuuuuaaaaaaggaugauuaugugaaucagcaauuagucugaaaaaauuauguacuaaagcucaagaaaaccuagaaucucuuuagaaaaacauuacauugaauaaguagucucuaauguaccccaugguggcauggaggcugagguaggaucagaucacaaguuuacggccagccugggcucugccucucugaugaaagauuccagcacuaagggcguuuacugucgagaugguugcuucacagucauggugaguagcuuagugaguaacauacugaaaaccaggaagagagcuaagaacagccuuuucuucaucccaggguuaugcgggaaagguugggugauuauauaguuuuuagcagauaaccuuugacucaagugacuuaugcaacuugcguggcuucuaaucuccuggugagagcccuccaucugauaccacagugcugagcucugcaaccuuggaggccugugucaguuaacuugcagacugagacaucuguagauguuuuugaucagugucuuucuagaccaucucaucaaaagucauaaaaggaacuggagagaugguucaauaauugagugcuuacuacuguuuuagagaacacgaguuccauucccagcacccacauaggguucucauaacugacuauaacucuagcuccagaagaucugaacccugucuagccucugcagguacccuguauacacauaaauaaaaaauaaaaucuuuuaaaaagaaaugcaucacaggaacagaaaugagaauauagccugcugaauuggcacaccuguaaucccaguauucacuagcagggggcaguggguaugagggcagccugggcugcagagugaauucuaggacagcuuuugcugaauaaccaagagccugucugggcuuaguggggggaguccagccauacuucacuacauugucuguauaggcugucuuuguuacagaaauauaaauaauaccuauacauuuuaagggugagaggguaagugagguucguuuauaguucuacauacaaaguuggcucuuaaauauuuaugacauaaaaaguauaucaugcuguguuaaaugaaaacaaaauuuagucacuauuuucacuauggguuugguuuuguucuaagucauagauaugccuggucugaugacauagcuaagcaguagaaugcuucccugugugaccccuagcaccacagaacaaaagcaguuccuaggccugcaagagugugcaaggcugacaagcagaggcuugaaaucccauaacucaagugaauguggaaggagcaguguacuccaccaagcuguccucagacuuucacacauguuugaaaacaaaguuccagaagauacacauagauucaaugcuucugauaacauagacuggccuacaccugggaauugauaauagucuccaaaguauuuguguuccauaugagaauuauaaguaauuuuuaagguguuugauuuuauuauaaauuuccuacaguguguauuuuuaaaguaagggaaauuaaguauuuuuauuaaaccaaauaauuuauucaagcauaguggugcaugccuuuaauccuagcauuuggaggcaguggucauccuggucuacaaaggaaguucuaggauauccaaggcuacucggagaaacccuauuaaaauuaauuaauuaauuaauuuuaaaaacuaaauuacuagagaaauaaugcacuggacuaaacaagaaugacuuaccaggccucaugauguuuucugucaaugguugccacagagacuccuuguuagugaaacagaggaacaguuuauugcccacagcaguaggagugugguguacauuugaaucaagguuuuagaccuucuuccugagcaacaaaccgcagaaauuaaauugauguuggaauuguaaaauauaguauuugucuucuguagccaccauggcuuuauaugacuucagggguucaaacuugggucuucacaagggcacagcaagaauuuuguccacuaaguuaucucccaaacucaaguuuuauuuugaugaaaagcuauuaauauaaaguuaacccugacuaacaaugggacuauaaagccugaacucugacucugugcgucugacucauguguguucuguagcagugugccaccugucucucugcaggaagaaggguacuguggccuuaccacaauugugaaaggcaggccaagcuacauacuggaaucugcugucuuuagagccauaagcuugucuguucuuggucuucgugggaagucguucaaaccugccuguuuugcaggaccuggagaaggagagugacacgccccuucagcaagugucuauugaagagauccuagaggaacagagggugcaacagcagaccagacuggaggcagagaagcugaagguccagacccuuaaagaucggggccuuuccauuccucgcgcagacacucuggacgaguacugaguccuugcucagagacugcucuagagagcaggugcugucaccuggucaccucacacauugaccagaguaucacgcugaaaagugaucucauucuuucauggaugccaacaugaagaaaucaugggauuuugguuuuuuuaaacaaaaucauuguauauuaguuuugcuuuucuucuucagucucagcacauaguccuggcugaccuagagcucacuguguaaaccagggugaccuuuagcuugugggacugcagguggccuccaccuccaccagcccagcuuuacugucuaaagaaacaguggcgugaccucccucacacaagucacuguggagccaagaacuaugucuuuauauugcuuaucucagaguuuacauuucuuuuuuaaaaauauuucauuuacuuguaaauaaaaaaugauucucagaacugucacaaaauggaguuucugguggagagucaaaauucccuacugcaacauaaggcuguauacauccuaauguauacacuaggaugccuacuguggauauagcuggcuccucaggaggacauuucauacucugcugcuuccuaguucccauuuucauguuuguacuuggcagaaguuuuaagcuugagaagggaguuuucaaggaacugguuacaacagaauccucagguuuagaaaacuugagcccugauuuacccacaguuuuuccaaacuauaagaauaugcuuugcucucaaucuuacauuaacuuauccagauuuucaacuccuuuugaucaucuuuugcuuagauuaucaucuauacaagaacaacaacccucccuacacacacacacacacaaaagcccucaaauggugcuuaguaacaauugauucaugaugacagcacguuuuguuggcuugauuguuggagaguaauaauugcguaggaagucugacagaugacacuuuagaagcaguguguuucaguacacagagugagcaaugaggcaacagcauagaaauuggcuuauuggcacacugaaauguuucucaguaauuuaucucggauauaucauuuuuuauaaucuuuugaacaguaguacucuucucuuuccuaagagguuuguggacuuuuucauacugcaauaugaaauacacuuuuuuauguucucagguguuuaaaaagaaaaaaccuacccuggaagccauuuggcacgugaauucuuuauuguugaguugauuuuacaguagauacuuuuugaaguuauuguccuuggauugaggauguggcucaguaaguagcagaaugcuugcuuaggauaugcaagguccacaugucacaugccuaaguacagugacauccuaguucagggacagcagagugacugguuaauugagcucugcguaggucacuuaguuauuucagcaucagucagacaauuccaguguagcagcagauaugaguuacaaagggacauuccugcccuugacaccuacguucuuugcaagguucagcugugugagguuuccaguccaggucaugcagcagccuggaaguggucuuaaaaguuaacacugucgggccugcuuccccucucuccccuuggguucucagcugagggccugcuucugcugcccuucccuguguucguacugagaggcagugcucugaccaaacuggccgucgcaggagcaaauccaguucauacugaaaguuccuaccagcuggggggauucgauuccccagagcccugcguguagccaugugcauucugaaacuacugcgcauggcugcuucaggcucuuuuaaugucucccgaggcccuucauauucaauuucaugcucucugcuuauuaaaccacaauauccucuccccucuacccugaauagaauacaaaagaaaaugu

SEQ ID NO: 12143 - RNA, 2879 nt, Mus musculus
gcaaggcacaauggcauauauuagucauccagaagccugaggugagauuuugggggguucgggaggucauucugggguacagagugagauucuguuucaaaacgucccaauccagggccauaggguaggcuuagaaaguaaacgugacugcacccaagucggacagccagagugccacaccggggagaacagacucccaacucuccucugaccuuccuggacacacacacacacaaagcacagauaccuacacagacaaacacagauacacaaccacacagacaaacacaccagcauguaaaauaaaaaccgagaucuguaggccgagguuaagagacucaggccuguuacugccacacuugggaauaugaaacagggggacugaaguuaaguucaugaauagcggagucuagaggaugagauccugucuugacccaaaacaaagauuaaaaaaauuuuuuuucaccgagaucaagaaaaaaaccuacaacugauggcuacccuggcugcaguuggacuccacacaucccauccucaguuuccccaaggaaaaggcaggaggucagcuuuuagggcguucgacuccacccugugaaacugacaaggagcuaaguaguuguggggacucuccaagggacccuccucugccucccccuuccugcccacaccugccagcucccagccggaggaacccuggccggcgcccggcccccgaggggcgugccuucggugggcgugacgcggggcguggcuucacagagggccuggguuuaugaggcuccacacaucacgccacagaagugccagagacaggggagagauagacgcacagaugagguccaguuugagaaacagagaggcaagaucuagagggaaguaaagaggggaggaagagaaagggaggagaggcaagaaacagcaggguagggacagagccugcccggcaauccaagcugggcguggugacccggccaaaccgcguucagccccacccccaugacgucaacccacaaugcagcgcguuguugugccauguagcgagcgucgcucuuggcaacagcggccgccaccaggcgagggcgucccgcucccgccccuuuaugcaaaucaacgacgucaccucgcgccaauggcgagcgggggcggugagcucaucgcgggggccgaggcuauaagagugcgcgcgggcggcgcggggcagagcggccggcaucggagccggucuguacgggcagcggacuggggggcauacggggccccccggggaggccgcggccacuccccccgccccggggccgagcgcggcgggggaagguggggauggaaacgcccuucuauggcgaggaggcgcugagcggccuggcugcgggugcgucgagcgucgcuggugcuacuggggcccccggcggugguggcuucgcgcccccgggccgcgcuuuccccggggcgcccccgacgagcagcaugcugaagaaagacgcgcugacgcucagccuggcggagcagggagcggcgggauugaaaccagggucggccacugcaccuucugcgcugcgccccgacggcgcccccgacgggcugcuggcuucgccggaucuugggcugcucaaacucgcgucgccggagcuggagaggcugaucauccaguccaacgggcuggugaccacuaccccgaccaguacgcaguuccucuacccgaagguggcagcuagcgaggagcaggaguucgccgaaggcuucgucaaggcgcuggaggaccugcacaagcaaagccagcugggugcggccaccgcggccaccucaggggcucccgcgccucccgcgcccgccgaccuggccgccacccccggggccacggagaccccggucuacgccaaccugagcaguuucgcggguggcgccgggcccccugggggcgcggccaccguggcuuucgccgcggagccagugcccuucccgccgcccccgggcgcgcuggggccgccgccaccuccgcauccaccgcgccuggccgcgcucaaggacgagccgcagaccgugccggacgugccgagcuucggcgacagcccuccgcugucgcccaucgacauggacacgcaagaacgcaucaaggcggagcgcaagaggcugcgcaaccgcaucgccgccuccaaaugccgcaagcgcaagcuggagcguaucucgcgccuggaggagaaagucaagacccucaaaagccagaacaccgagcuggcguccaccgccagccugcugcgcgagcagguggcgcagcucaaacagaaaguccucagccacgucaacagcggcugccagcugcugccccagcaccaggucccggcguacugagcccgagcgcggggcgcaugcgcggacuagcugcggugggggggcgccccggacucuuucgagacucggugcccccggacucgacaagccggaccccccuuaacucuggauggggaacccgagcgcacgacccccgcccucgcgccgccucucuacccccaguccugcgcguggcugccccuuuguaccuccgaguaggggcucuaaggggcgcgcagccucacgcucugccuuuccuuuuuuuuuugccuuuuggaagagagaacgggaguguccgauuccgcccuauuuauguuucuacucgggaacaaacguugguugcguguugaguguguguuuccuuguguugguuuuuuaaagaaacgggaagaagaaaaaaaaaacccucuccccuccccccccccccgcucucucuccucccgacaccauccccucucuuuuuguuugguuuuguuuugcuacgaguccacauuccuguuccguaauccuugguucgccgguuuuguguuuucaguaaagucuucguuacgcca

SEQ ID NO: 12144 - RNA, 3099 nt, Mus musculus
ugucuucgucacgugauguggcuaucucagggccccaguucuugcaggagaaaaauaaggaugagcgagaacuggggauccuccuguauucauguuccggugugggucucugugagagacugaugggaaggcagaggaggcucagucuucccucaggguacaggggaaucugagguucacagccugcuuaaaaccuuggugcugucaaggucacagcucugccuuauguugguuggggggguugagcaugugacauugggggguauccucaccuaccccugugccgugcccacccugugcgugguccugaugcuccccucaggcccucugugccacgccucccgcagauggcuuccgccacagacucucgcuaugggcagaaggaguccucagaccagaacuucgacuauauguucaagauccugaucauugggaacagcagcgugggcaaaaccucguuccucuuccgcuacgcagaugacuccuucacuccagccuuugucagcaccguuggcauagacuucaaggucaaaaccaucuaccgcaacgacaagaggaucaagcugcagaucuggguguguagggcuggaggggagaugucuuccugccaacccccacaaaaggaagcugaggcuagccaucggcuggcgcugggauuuaaggccugcaucuccaucccaguaugagcuucccguuuuccuaagucccgagcauccccacucaucuucuagcauaguguggcacagggcauucaggcagcacccaguacauguuuguugagugacuaaguggccuugcagugacccauuugggucacugucugcuuuuccugacccacuguccccgggccucaaagugguugcuggacaaccuuggagcacguuuuucucucgggggcugcugcgaggucccuucugaccuaucccucuuuuccccaggacacagcagggcaagagcgguaccgcaccaucaccacagccuauuaccgaggcgccaugggcuucauccuaauguaugacaucaccaaugaggagucauuuaaugcagugcaggacuggugagcagcccaccuacucagaaaacacaaggcugggauuggaggugacuuagcuaagcuuagcuaagcuuaguugguagggugccugcuuggccaggacaaagccuuggguucguccccagcauggccaaaagacaaccaagaguaggccucuggugggacaagccauguggcuguucccaaggcuugagguuguggaagcacacaagguaaccagugaguagacaaggaaccucccacugaucucuacccagguagcccaggcaggagaaccacguuagcucacuugucugaggucaagugauucucuggccaagcgcuuaccucaaauguaugagaaccuggauuccagccacagcaccaaaaauuaacucccccaggucuugacauuugguguaguggacaccggcccaucuucccagcuuugggaagauggagaggucugagugagauaggcuggacucaguuaccaaggggcaguggucucuccugcaagggcuagacacaggcagagacucggggauggggccagguccuccggcuuccucuucagccucuggcugucucugcagguccacucagaucaaaacuuacucgugggacaaugcccaggugcugcuggugggaaacaagugugacauggaagaugagcgagugguguccucagagcguggccggcagcuggcugaccaccugggugaguacugaggacuguggcccuuaccaggcuggaccagagaccuggauaccugauagcuacacacccagugucucacugaucaggacaugggcuugaauccaggggguuugcacuugagaaaacuaggccuuauccaggaggcuuuaccaugggucuugauggacauggaggugcuugccauguuggcugucagcugucagccaugagcuaccuucaagguacugggccugugaaguuuucgaacuagaaagagaaauggguggaagaggcuaagccuggcuucccggagcaggcacaacaugccuguaugggaagguugguauaggcagagucgugacaguggugcgugaucgccccuuagaggaacuguggcugucacugcaggcugagcugacaagaaaccaggccauggagguuguaggucucuggaaagggacuuggagccuggcuggguggcagauggaagggaugucucacuagggugcuuaagauuaucccaagggauggguaguaauggauggcucacccagaccaguguggccucccugggagggacccuucagugcgagggccugugugagugcgucuggagccuacagcucuguugccaccccuccauuuccccaauauaggcuuugaguucuuugaggccagcgccaaggacaacauuaaugucaagcagacguuugaacgucugguggacgugaucugugagaagaugucagagucccuggauacugcagacccugcggucaccggugccaagcagggcccgcagcucaccgaccagcaggcgccaccucaucaggauugugccugcugagccacuucccuucccugcugccaggggcacgucccccauccccgacuacccuauuuauuauuguagcuauuuauuuauuuauugaggaugugccccgagcgcacccccuucccacccuguacauagcuccacccagcucggccgugguguauuguggucacugcugcucccucuccuuuaccccccacccccauuuuguuuuuguaaaccaucccguccacaguugucaguugugaagaggggaccagaugucacucugcagcaggcugauggaagauggcggggccugccaaccccgaggcugggggaucgccauauggaccaccugguugacagacggcuucuugcuugccugggccuucugccuuauacuuugggauaaaugggguguaggggauauauucacuacuuugggauacccccaaaccuguucugacgucgugagugucaaaugugucccacuccucccuagaaguuaugaacacuacacacagucaauaaagcgaauggaccuugcug

SEQ ID NO: 12145 - RNA, 3099 nt, Mus musculus
cagcaagguccauucgcuuuauugacuguguguaguguucauaacuucuagggaggagugggacacauuugacacucacgacgucagaacagguuuggggguaucccaaaguagugaauauauccccuacaccccauuuaucccaaaguauaaggcagaaggcccaggcaagcaagaagccgucugucaaccaggugguccauauggcgaucccccagccucgggguuggcaggccccgccaucuuccaucagccugcugcagagugacaucugguccccucuucacaacugacaacuguggacgggaugguuuacaaaaacaaaaugggggugggggguaaaggagagggagcagcagugaccacaauacaccacggccgagcuggguggagcuauguacagggugggaagggggugcgcucggggcacauccucaauaaauaaauaaauagcuacaauaauaaauaggguagucggggaugggggacgugccccuggcagcagggaagggaaguggcucagcaggcacaauccugaugagguggcgccugcuggucggugagcugcgggcccugcuuggcaccggugaccgcagggucugcaguauccagggacucugacaucuucucacagaucacguccaccagacguucaaacgucugcuugacauuaauguuguccuuggcgcuggccucaaagaacucaaagccuauauuggggaaauggagggguggcaacagagcuguaggcuccagacgcacucacacaggcccucgcacugaagggucccucccagggaggccacacuggucugggugagccauccauuacuacccaucccuugggauaaucuuaagcacccuagugagacaucccuuccaucugccacccagccaggcuccaagucccuuuccagagaccuacaaccuccauggccugguuucuugucagcucagccugcagugacagccacaguuccucuaaggggcgaucacgcaccacugucacgacucugccuauaccaaccuucccauacaggcauguugugccugcuccgggaagccaggcuuagccucuuccacccauuucucuuucuaguucgaaaacuucacaggcccaguaccuugaagguagcucauggcugacagcugacagccaacauggcaagcaccuccauguccaucaagacccaugguaaagccuccuggauaaggccuaguuuucucaagugcaaacccccuggauucaagcccauguccugaucagugagacacuggguguguagcuaucagguauccaggucucugguccagccugguaagggccacaguccucaguacucacccagguggucagccagcugccggccacgcucugaggacaccacucgcucaucuuccaugucacacuuguuucccaccagcagcaccugggcauugucccacgaguaaguuuugaucugaguggaccugcagagacagccagaggcugaagaggaagccggaggaccuggccccauccccgagucucugccugugucuagcccuugcaggagagaccacugccccuugguaacugaguccagccuaucucacucagaccucuccaucuucccaaagcugggaagaugggccgguguccacuacaccaaaugucaagaccugggggaguuaauuuuuggugcuguggcuggaauccagguucucauacauuugagguaagcgcuuggccagagaaucacuugaccucagacaagugagcuaacgugguucuccugccugggcuaccuggguagagaucagugggagguuccuugucuacucacugguuaccuugugugcuuccacaaccucaagccuugggaacagccacauggcuugucccaccagaggccuacucuugguugucuuuuggccaugcuggggacgaacccaaggcuuuguccuggccaagcaggcacccuaccaacuaagcuuagcuaagcuuagcuaagucaccuccaaucccagccuuguguuuucugaguaggugggcugcucaccaguccugcacugcauuaaaugacuccucauuggugaugucauacauuaggaugaagcccauggcgccucgguaauaggcuguggugauggugcgguaccgcucuugcccugcuguguccuggggaaaagagggauaggucagaagggaccucgcagcagcccccgagagaaaaacgugcuccaagguuguccagcaaccacuuugaggcccggggacagugggucaggaaaagcagacagugacccaaaugggucacugcaaggccacuuagucacucaacaaacauguacugggugcugccugaaugcccugugccacacuaugcuagaagaugaguggggaugcucgggacuuaggaaaacgggaagcucauacugggauggagaugcaggccuuaaaucccagcgccagccgauggcuagccucagcuuccuuuuguggggguuggcaggaagacaucuccccuccagcccuacacacccagaucugcagcuugauccucuugucguugcgguagaugguuuugaccuugaagucuaugccaacggugcugacaaaggcuggagugaaggagucaucugcguagcggaagaggaacgagguuuugcccacgcugcuguucccaaugaucaggaucuugaacauauagucgaaguucuggucugaggacuccuucugcccauagcgagagucuguggcggaagccaucugcgggaggcguggcacagagggccugaggggagcaucaggaccacgcacagggugggcacggcacagggguaggugaggauaccccccaaugucacaugcucaacccccccaaccaacauaaggcagagcugugaccuugacagcaccaagguuuuaagcaggcugugaaccucagauuccccuguacccugagggaagacugagccuccucugccuucccaucagucucucacagagacccacaccggaacaugaauacaggaggauccccaguucucgcucauccuuauuuuucuccugcaagaacuggggcccugagauagccacaucacgugacgaagaca

SEQ ID NO: 12146 - RNA, 9870 nt, Mus musculus
ggucgacggcccagcaggaacucgcgcugcgacgacgcucgcucugagaguccccgacguccuccgcauccucuccguuccgaguuaccugucuccauggagggcgcggaggcaggggcccgggccaccuucggccccugggacuacggcguguucgcgaccaugcugcugguguccacgggcaucggucugugggucggccuggcccgcggcggccagcgcagcgccgacgacuucuucaccgggggccggcagcuggcggcagugccuguggggcugucgcuggccgcuagcuucaugucggcugugcaggugcucgggguccccgcggaggcagcgcgcuacggucucaaguuucuguggaugugcgugggccaguugcucaauucgcugcucacagccuugcucuucuugccgaucuucuaccgccugggccuuaccagcaccuaccagguaggggacuuggucccaugggaagguuccgggaagaugccgcgggcaccgggcagggccaggaaggaggaagagccaguccgggccccacagcucgcagcagccucggggcaguggccucccgcugacaccugucccugcgagugcccguaccagccacccaccggcgcccgacagaguucaaacgccugcagugagguguaggauuucccaaacgcucaacaacuguagugaaaacggaauagcauccacuugcaguuucagcacuagggagauugaggcaggaggauugccaugaguaccaggccaguuuggacucccuagggauaccccaguuucaaaucugagggcgcaacuaggcacccugaaacaacgguccaacaaguguagcgacaauaugaagucccaugugugauaucucaguacuagagaagcuuuggcaggaggauugcugcgaguuccaagccggcuuaaccuacacagagacucuguaagcucaguugggcacuccggaacagaguagaaacagugaggauggcugaggggucacuugcccgguaaccuccagcccuuggcucccucugcaguaccuagaacugcgcuucagccgagcgguccggcucugcgggacgcugcaguacuugguggccacggugagcgagcugcccgcccugccacgcccacacgagcaauuaucauagcccgcuccaaccugaccucacgccacaccccucauccuaccuggccccgcccccuuccagcuugagcuaagcuucucugggacauacaaggaccacgccuauagcucugcccucauucugccuaugggcacccucucaccuagcuccaccccauccuaccuaaaaacaccuucuugcaaccuggcuccgcccuuucugccugauccgcgcucucuucuuucugccuccaacccguuugcccgccccuugccaucaccgaccuccccacccacagaugcuguauacuggcaucgugaucuacgcaccugcgcucauccugaaccaaggucuggcugucgggagcgggaggggccaggagcccaggcuggacccuacaugagcaggcaggaugagggagaccugacaggggguguguuuugcagugaccggguuggacaucugggcaucgcuccuguccacaggaaucaucugcaccuuguacacgaccgugguaaguggguugugguggcugacacgcggaaaaccucaggcaggcagcaccacuccagcuuccuggcaccugagguagccgcagccugccuaacugugcccguguccucuccuacauaaagacugauagacaugugagcuucaggugcggcuggauccagcagcccugacagagcuuuaccuucccauggucacucuggugccaaaacuggcccccugccuuuccuggcuccugcccagcagugaacugguuucagcuggaucugccugagacucuggccuagucuucuccugguccccugauuggcugugccaccuaagggacuggcauguucugguugcuguuuauguacggcgauggaggcucagauuucuaugaauggcagggagaaauacauuugugaaucagaaguagcugcuuggcuccuuucacagcagcauuggggaggcuggaagcuuguaaguucuaggccagucugagcuacauggaccagaaauaaacaaaaagggauaaugauaauacuggguguuggauuguuugcugggaugccuggggccauugcgucuguucccccuuaccuuaucuaauccucugacugaccauagaaacacacaauauuucacagaugugccacaggaagccaggcagggugagcugggggugcucuucagccuucuccccacgcagcccugccccagcagcccugggcggguuugugaccuguauccccucucccacacagggugguaugaaggccguggucuggacagauguguuccagguugugguaaugcucgucggcuucugggugauccuggcucgaggugucaugcucauggggggccccuggaacgugcucagucucgcucaaaaccauucccggaucaaccugauggagugagagauggugccucacugugcagcccaggcuagccccacuucugucccucagccuucccagcacugugucucagaggggaacaaaacucaacauagaaaacuccuacucauacuucaaaacucacugcaaauguccccuuaggaucuagaaaaggcauaggugaucuggggagggugacauccucacaugguuguuuuuguuguugaguuuguuuguuuguuuuguuguuguuuguuguuuugguuuugguuuugguuuuugguuuuucgagacaggguuucucuguacagcccaggcuguccuggaacucacucuguaaaccaggcuggccucaaacucagaaauccuccuuccucccaagugccgggguuaaaggcuaaaggcaugcuccaccacugcccggcuuggucuuuuuucuuguuuuuuuguuuuguuuuguuuuguuuuguuuuguuuuguuuuguuuuccucacaugguuguuaaccugccucauucccuacucagcuuugacccugacccucggagccgcuacaccuucuggacauuuguaguagguggcucccugguguggcucuccauguauggugugaaccaagcccaggugcagcguuauguggccugucacacggagagaaaggccaagcugugaguaugcagcgagugugcagugagggacccacacagaggcugcugggacagccuggcccuccccacacacuccuaaggccacuccaucccccagugcccugcuugucaaccagcuuggccucuuccugauuguggcuagugcagcuugcuguggaauugucauguuugucuacuacaaggacugcgacccccuccucacaggccgcaucgcagcccccgaucaggugagcucugcucagcuuucccaucgugggguggggcuagaaaagcauuccuucuagaaggcacaggcugcaggcuuuugaugcagagagcucagaggcugguccaaggaaagcuggggggggggggugagccugggaggcaggcaguagggagccauaguggagugagagcagccagaggaccuuucaacugagagucagucacagaaaugcccuaggaacaucaaggagagggaagaccucaggcagccagugugacaggacacuuaagauaaugauagcuggacucuuccuuuuggaggguaagggguuguugagauagggcuucauguagcucaggcugaccugcaacucacaauguagccgaggcugaggcuggccugucuccgugucccccuugucacagaggccucugucuuccacaguacaugccauugcucguguuggacauuuuugaggaucugcccggaguccccgggcucuuccuggccugugccuacaguggcacccucaggugggcucccugcugccccucagcaugacucugcccccaggggcucuggugcuaauugacuggccagcauccccuggaggaugccaaggucuggccucauccaucaguuagggaggauggcccugggaaggggacugcaccagcucucucgggguguccuaagacuuauuucuccucccuccauccccagcaccgcguccaccaguaucaacgcuauggcagcuguaacuguggaagaccucaucaagcccaggaugccuagccuggcaccccggaagcugguuuucaucucuaaagggcucugugaguuugggggacuaggguucaggaccaggaugguacccuacacugacugagcuaccccucccccacagcauucaucuauggcucaaccugccucacuguggcugcucuguccucgcugcugggaggugggguccuccaggugagacccccaaccccaccugucuuguaccuacgugagucucagcccagguucagggagauguucgggcuauuggacacuacuagcugggaguagggauggggugguguugaacgccugucauccuagaggcugaggugggaaggugaggaguucgaggccauuccuagcuagauagagaguucgagggcacacgugaaacccaccacugacucugucuacuagccuugggggagaaauaggacugagaaaacugggacacagaggaauuucaaaaccugcagugguuuugugcugagaaguggugaguaagcccaguccuuuuccaccugccuuucagggcucuuucaccgugaugggugucaucagugggccucuccuuggcgcuuucacccucgggaugcugcucccagccugcaacacgccagugaguagggagggcugggcguguccugugagagaugagaucaaugugccccgccccucacuguggccccgcccccagggcguccucuccgggcugacagcaggcuuagcuguaucccuguggguggccgugggggccacgcuguacccgccuggagagcagaccaugggggugcugcccaccucggcugcgggaugcaccaaugccucuguccucccgagcccacccggagcugccaacacuuccagagggauccccaggugaacagcccggagucgggggggggggggggcuggggggggaggguccagggugugaugugaggguguuaacaggaauggacugggagcagaggaaagagcauuccuagagggacaaaaucgguuugugcaaaggcccucgggccacgccacguucaaguucuaaggcuacagggaggugaucugguuuuaauagaagggcagaggaaccaaaggcagaagaauuggcuugcuuuuccucuuauuuuuuguauuuuaguacuuugagagagucucagguaacccaggcuggcccuagaacucucuacauagccaaagaugacccugaacaaaccccugauccuccuuccucuaccugcugcaugcugaggugacaggugugcuccaacauaucuggcuacucugguuuuuucuucuuuuccuucuccuccccuccccccuccccccuccccucuccuccccuguucuccccuccccuucccuuuuaggucucuccagacaggguuucucuguguaguccuagcugugcagaaacucacucuuguagacuaggcuggcauagaacugucuucugucuuuauuaauuauucuacuuuuuauugggauguaauacacagcuaaccauaaaagcuuagguuuaacuggguguaguggcugagcuucgcagcacuuuagaggcaacaggcuagaucauaggcuauccuugacuacaagauaaguuugaggacaauuugguccacauuaauaaauuaauuuuuuuuaauucucacuucugggaagaucccuauuuuaagucuguggguugaccucuacuaggcauuuccuaagaacaaaaucuuacaauaugugaacuuuugcaucucaccuuguuuuggaaauucauccuugauuaucuaugaccgaaguguccaccaucaguuccuucccuuucagggcugagugauauuccauugaauggauauaccacauguguguaacugcucaucaguagauggccauaugggugaugcccugguuggugcuguugugaacagaguuccauauaccuuugugcacacagccaagugugcacaggcuucucuuccuagcccuggggaaggcuugagacuuugucucaaucgaggccuggucuugggguguugcucacugguugaguacuagccuagcauuggagagguccuggguuccuucuagaaaaaugcagagaaagaagagaagaugcuagaugaaacuccaugcccaucuaaaaccuuccaaagcuugguugggucuggcuggcauucuccugugugugccucuucagaggacaggucuuugaagguuuugaccagaagguuguuuucuaagcauucaguuucacuuaauugcaagaucaaugggcagccauggugggugguaggcuguagcagaaagagaggagacccggcaacugcauacaucucuguauuugagggaugacugaaguuggucucagcugacacagugggcugguggacaaacaggaagaaggcaucucacaccuguccucccccaccgcaguucuggaauggacucgggccgcccagccuuugccgacaccuuuuaugcugucuccuaucucuacuacggggcucuggguacuuugaccacuaugcuuuguggugcucucaucagcuaccuaacugguaagugcagcagccuccucuggggucagcgguugguccuccugucuccacccucaacuccccaaagggagagaugaaagagauucccaugcggcugagagcuggcacauuuuuaccucauccuugagacgccccacaaggccgguucuauuuugcagaugugggaacuaaauggggcagguuccuccggaaagucccugcuauggccggggaugcgggacgcuguccgcgguccugaagcaaaucagcauggggaggcccuugggcucuaacaacauccuguuugcuuggauuugacaugggggugggggaucucucucugcagcucaggcugacccucaugacaauccuccagccucaccuuuaugaguacuuggaugacaugugcgcaucaccgcacucagcacaggcuauauucucuuuuagucauauauuuccuuuugagacagggucucacuuagccccggcaggccucgaauuccuuaugaagcugaggcagaccuugaauuuaggaucccccucuuccacccacuccugaguguauucaccaccauaccugguuuaugugguucugaagguggaagccggggcugccugcgugccaagcacucuacccucugagauggaagcauuugacacccgacccucaggcccagccuggcuuacuccuaugacucagcgacuuggugcccccaggcuguugcugaacuucuagacauuaggguugaaacagugaagggccaaaggcugggcacagcucccagccagcugagcugauggcgccuaucugugaugccaacacuuggaaggcagaggcaggaggacugacugagcuguagcccaccugucucaaaagugaaaaauaaccuaagacugaaaccaacuccucacgauucagaugaagcaacugagaugaacugggugggccaccauggcuggcgauggggcugggcaagcacucaacgcugaguccccguccucucugccccucaggccccaccaagcgcagcucccugggccccggauuacuguggugggaccucgcucggcagacagcaucuguggccccaaaggaggacaccaccacccuggaggacagccugguuaaggucagauuuagcccaggucacugggcgccaaggucauggggaccuggcggguguggccaaaggggcccggcagauuccucucugugguuaaagucaucccuuucccaggggcugacacaugagcgcugucuauuuuuaucauaucuguuuuuuuaaacaaauauuuccugccuguggcaggggaaacugguuuccccuugagagagagagagagagacacucaugaagaagucuuaagauaacauuacuuaauucagaauuacauaagaaaugggggggcuggaggggagagcuaggcuggagcugaggccggggacuguagagccagucgaugaucugaaaguuggagacacugucaccucaggucaagugaccagauugacacaaaggaaggagaaguuuuucuaguacaugacaccaaagguagaaauguggagugccaggccaggaguucgaggccaacccgagcuacauagcaggccugaggccaguguagaucucaaguaacaguaggaaggggcuggaggcgccagcugggcuggcaaaggacccaguccauucaggcaccacaugaggagcaccaccaucugucacuccaguucccccagaucugaggccccaggcaugcacacacgcuggcauaacacccacaccccauaccuguaacauagaaauaaaauaagguuaugaaccuuagugaucccaguacugaggcagaaggaucacugcaagucugagguuacaccgggacuggggcugggccuugguggaacgcuuucacaacaccagggagguagaggcaggaggauggaccucagcuacaaggcuagccuggacagcagcugacucugauggagggaggggugcugggccacucugcauguagcugaccuaguuaguccucugggaccccaucuggggcggguguaugauguccuacacuuucuuccagggaccggaagacaucccugcugcgaccaagaagcccccuggcuucaggccagaagccgagacccacccccuguaucuggggcacgaugcugagaccaaccucugagggcgaggcccgagaaagccaaucacaggccucgggccagcagccuccucucugaaugguuggaccaucaccuguacagaagcuuggcugauagaggcccugcccgcccugaagucccugugucccaccugugccccccaaaagaggguugguucucuauccaccaaggaaaacaucuggaaccgcagugaccuuguagauugcaguaggcaacugagaacacucagcuucuccagaccgugagguuuucccauuuaacaagcagagaagcugagggcggucaccccaacgcugggaagguagaggcaagagauucaggaggucaagaucauccacagcuacaggcugagacccugcccacccccaaauauauaaaaguaaucugggugagccgcguggcuucgcgacagagggcuugcccagcacacagaagacccaaggcagagggagaaaugggauguccacagaacacagagccccaaggauugugaagcuuccgcgaagugccaagggacagauucucagagcccucacaagacacggauggacgaguugccuccucaaagggacugacgguuugcagacuaucagagaacauguuccuucugugaucagccaccuaggcuccgcuaaugcguuccagcuuccaggagacccugcagaccccaccucccaugcucucugcccuuuaccccugugcuuuguacacacuaggcaccugcucuaccacugaaccucacaccuacaccuccauuuuuauuuuauuuuugacacagugucuuaagguagucuggcugaugucuggcuaucacucagcgcuuuuuuuguauaucaauauuucauucuuuuucauugccaaguggucuuguaaagacauaccacagugugucauccauucccaguggguggaugggugaauagcugcauuguuuucagcuuuuguguacaccaauaaaauugcuguagguguucagau

SEQ ID NO: 12147 - RNA, 36437 nt, Mus musculus
cgggcuggccaacgggucacguggcgggucggcggcgccggcgguugcugucaccugauucugggagcugguggcagcgguagccgcggcaauggacuuucuccugggaaauccguucagcucuccggugggacaacggaucggugaguccccggagccgcgcgcagucccgccccugugugccgcucuggccuuggcccugggaccugucggaguccgcagucuggcagacaggagggaggcuaggcggugaggcuggcgcggcgcucugggcuccgcccacccuaugacccaccugauugacaagaacacgggccaaucggaagucuuauauggggauugaugcuugauguagccaauaggcaguggaaggaggcgguccugggcggaugugguucagccaaugugugcgugcugggguccgaguagagggagaaaguuuggguuaaagggacugcugugaugagaaggcguugggccgcgccaccaccgggcgcgcgcagacuaagagccccucccgggcuggcggcgucuugaucauucgccgcgucaccgacucuucacauuccgagacgccggggugucuagguucggccgcgccucuguccccauggucgggagucucggguuuaugugacgucgcccccgugaugguccucgcccauaguuaaagggucauggcccagccuuccuggacuuguuugaucauuaaaugcauuaauaagauagcacugaggauguuuccuggcacauggcuaacgccugucauugucaacguguuaccaccuacuggggcuggagcccaugggaaggugccggcucccagcaccuacucucgggcaaaggccaggcggcgacguuuccccaggaauggguggucugggcgugacauccauacccccuuaccugaagggucccgacggcauugugaaauugggaaggccgaaucugaaagcuaaggcuuccccugaaacuguuaacccagcucuguguuguaaccaacacugcagcuguuaguagcucuuuugagguucucaucaguucucugcaagggagcucugaugccugaagcccaggugcuucaccauaaaucguuguuugagaccuggaaagagaaggcagucuucuucgcagauuuccuauguaaaacaggcaaauuagucuggccuucaaagccagccucaaaguccugagacuuuuuggauaaagucuuuuggguucagucuuuuaaacugccugucaguucaaagcucagcaucucuccugcccugaaaguugccugccuugggcaagaaauacuucugauuaagaguacugcuacaucaguaccucagaacacugacuaaaucucacugcuggacccuuucugccuugggguucaugucagaccuauccaagacucagaugggcagguguaggguucccaguucucuuugcaacuggcugggaaaccacacguuuugaaauuucccaccagaagcagugguucacaucuguaauccuauacccaggagacuaagacaggaggauugacacaaagucccaggcuagcugauucugaaauuaguugcaggguaacauaagcugcagaguaagacccaaaaccaagugaauugagacaagauggcaaagcuguaaaagagccagguaugguggcacaugccuauaaucccagcauucaggaagcugacacaggaugauuuugaacucaaguccagccugggcuacagagacccuaacuuaaagaacaacaacaguaucgguguuacauacucuuccguguauagagauagaagcacuggagauugagucugcauuuguuuuugagacagggucucgcaguguugaccagguuggucagaaacuucaggacucaagaagucgucucccaucagcuuccaaguagagaagaccugacuggcugugaugauuaaugacaagcagguuuuagcugcuuguauucuuauaauccaagccccucuuugcugcaggaguaaaguggugucuucccaggucugcugacuuccugcccugagaguggagucucauagaauuggcauccuagaggauagcagucauuaagugguguuaaucagagcccagugucacuggccucacaauucacaaacaccuugauaauugcuggucucacagucuggagugcugccaugccacaugcugccaugaggaguugggcucauuccuggaagcacugggcaccaucaccuccucccuaaggccauuucccaacuccucauccaauuucugcucuuuuguucuguccucaaucuauuaccaguaggcacaaaacagcucuaaccucaagagaaaucagagauaguucauccuaucccuggaucaaauaugaauugccgugacccaagaacacagauucacaucacaccgaauaagagaugauuuccuguuuuuguagccacagagaacaaaagcaagcuauaaaucagacacucagguuacagcaaagcaugaaaaucuaugcuacaugucucaggugcuagcugaugacauuucuaacucuuggguugguggacacuaguuuucuaaguuaccugguaagucacagaaauguuaggucagacacagagaugagcaauaagcaguuacuaaaugaucuaaagcaagguaauuugucucaagaucugcagcauuccaacucuccacaaucacacgguuguaaucaaccuucuaacaucuuuaacacagguauagcucuccugggaacuucaguuuguaaacuugaacucucuugcuugagggaaguuauaagaaagcuggucccucggugagugacugugcagugagaggguauggaaagcagcuccugcucucuaguauuccuuuuccaccuccaucacacugauagcaucacugucccugcaagucugucuucagcuuggcuugaguugaguucaaucccucccuuuccugaugccuuagcuccuagaaggaggugaacaaaaaagaaaaaaggaaggauguggcuggucuugaggaugggggaggagaauguuuauuguaaauaaaagagagagcaugaccagaggcaucugggagaauccagggugagugugaguagacugcgcugggccuugugcagagcagagagggagcagagccaggccaagggaccugaaagguaaagguagaugaaaaaaggccagauagccaaaauuacauuguacauuguauagggaaggaagucuaagcuaauacaugcgcuggaaaaguuuagggcagggguugggaugugcuagacaggggggcccugcaacagguagggacugaaggaugcugggagaaccugacugccaaauccacuuugauauguuaaauaggcaccugaggccuauuuauuugugccagguuugagaccuaacuggagggagagaagccuagcugcucagggucacacuuaagacccagugcucucucuugcccugaacacaccagucuacucagguccuaguuugaauuuauauuagcagaacccugcaaaauuaaucugugcuaccacagauuagagauaaugaugaguuuucacccaccuccaagucacucaggccaacuccaggagaccuccacaggggcgccagcaggcugugggccugaggguucaguggcuuauaccaagugguagcacagaguccucuuucaagaggacagagcuuacuguagaggagauuucccccuuccauuucuggcuguccagugaugcuuagacgccaacugcagaugcccccacagauaugggcaguuccuggguaccagucucagggaguuaggacacuggagcucagacugaggccagaccugggcgaggaaggcaagauaaagagcauacaccuauaaucccaguacucaagagacugagacaaaucaauugccaugaguuugaggcuagcuugggcuacagagacaacuuguguuuucaaagugcacacacacacucacauacacacacaugugcacauacagguagaucuguccuuggauucccaaaaccuccucagccccauagacaugaaucagaaauuaaugaccagcaucaggguccuggggcuccuuuggagcagaggcaggaaacccacagacuagacuguguuguagcuguugggcuggcucaggagaggugcucucagucccugucugcuucugacucuugcagcccuaucuauaauggaacacagaggcacccccacucccucuccugcccaaaggacuggugaacagcagcugaaaagcaauggaaauggggacguguuagugcuacauggcacagaaaggugaugugcuauuccaagaggaagucagagccaggcggcagccaagccuagaccugucagagacuggcuagguaggggucaaagaagagagcuucagaggacucucacuugacugucaggguggacuauaccaggcuuacucuccaaagggccacacaguaaauccucaagacuucagaggccaucuggucucuuaaaauacucaacaagaucauuguugcagagagagccaaagacaauagguaaaagaauagguguggucaugcuccaauaaaacuauaugaccauguauuugaguucaugucauugcuaugugucauuaaacauuauucuucucaggugugguacugcaugccucuaaucccaguacucaggaggcagaggcagaggcaggcugauccaggccagccuggucugcauagggagacccuaucucaaaacaaugucuacguagggcuuugccuuggcuggacaaauucuaguaaugcccaaggugaccuugagucagaacacuagcuuuguuacuugaaguagguuacuaaccucacuaucucugguuccuccucuguaaaaggaggcuaauaauagcaccuggcaggugggguugcuguguauauacuguguggcauuugaagcacuugguuugugccugccugaccagaggcauccacagcuguuagcccuggggauucuuguagguggugucacuguuccuagggcacucuuacugacagagcuaaaguaauaaugcaggacccugacuccaguccagcuuguguuuuggucuuugugucauugagauaugagcagucacuggcuggguggcugcacauucacaggcuggucagguuucaggcagugggguggagccaguucuccuggggauugaaggcucagccugacuguggauugaacugguaaauagguuuuguucccacauggaacacugagaaauaagaguaaaauccuaaauuucuggucuugggggugguguucaggcagcuaaacuaaaacucucaguauguagcuaacuuggggcugccauuccauaacuggaauucaggacacugacucuagcccucugacgagguucugaucuaggccagggcucucaaacugccacauuccucugccgccuccugaccuucuguaucugugugccuccuuuaucauuuccauggugcuuuccuuuaauugccucguuuaagcuccuuuaguuccauccuucauaauuauguccaugaugucaugacagcaagcacccuuaccaaugagccauugcccuccaucauguggaugauccuuaaucagugaagacuuccuuaaaggauuggcauccccagagcaagggaaacucugccagccacacgucucugcagucuuguuagugcgugccuuaaaguuaaaaucagugagcccacugguauaugcacacucauuuauuuauucucucccucucugucucugacucucugucucucuggcucugucuuucucucucuggcucugucugucuaucugucugucugucugucucucucucucucucucucucucucagucuuccauuucucuuauauuuuguguguguguguguguguguguguguguguguguguuacaugguacaugaaugcacauguguguauguacaguuccguguguauuuguguaccuguguauggaagucagaggucagaguuaaaugucuuccucgauugcuuuuuugagaguggcugucucauuaagccuggugcacuccaauuuugcagacuaccuguccaguagcuccugguguuguccugucucugccucuccagugcugugguuacauguacacaccagauacccagcuucuuauguagugcugggaugggaagccacgucauuauguuacacagcaagcacuuagccuuaccuuguuucuccauuucucugagcccuaacauaucucagagcucucuccaccucccauacucaggcuguccucacaucuugcucaaucauggguggaguagagaaaugucaccaagagucagcccuugcauucauggucuuggucccuccugccugaacaguuuaggaaacccuccuuuguguaaccaaaaguuucuucagcaagaacuuauaguuaguuacaucuucuugaaaacuguggacugaggaaacaauaugcuccuuaagguauuuuaagguuucucuuguggccugugguuuaaaaaaaugacaggggagagacagccaggguuuuaagaaaggacauuucagcaacuuaggaaacugauagaaguuuccaggcuggaucuagaaggaaagaauuguugauuuggaaaguaggcuucaugacaacuugcugacuagaaagaaaaaaaaaaaaaguuggcuacuguauauaacuuuuagaguauucuuuaugugaagguuugaaauuuugggcugguuuguggcugauauuuuuggggugaguaacauuuguuuuggugcugaugcugcagucagugggcacaacacgcuuaaccugcauccuuuuuuuuuuucuaaagauuuauuuauuauuauacauaaguacacuguagcugacuucugacucacaagaagaggugucagaucucauuacuggugguugugacccaccaugugguugcugggauuugaacucauggcaugaggaagagcagucagugcucuuaccugcugagccaucuugccagcccaaccugcauacuuucaucuccuucucacaacccuugggaaguggguaccuuaggugcccuauucugcaaaggaagaaugaggcucagaagggcuaaggcauucacucggggucacacagccacugacugcugaagucaggaccuacaaugcaaauugucuauucacaucccauguuucuagucucccuccucaccacuguccugcaggacugaaagggacucacuggucuucuccaugagucacaggguauucaucuugagugaugugugcacuaguggcuccugucuuccugcaucuuccauaccaauguccuccucagggcagggagcucugcugaggguaccagcaguguagaucucuuuaccaggagaacagagcguacagguaccuuccagggacucccacuuuguucaaguagcuaggaaugagugaagaagagggacuaggaaugcaaaacagugugagcuuagggagaucgucugucacaguaacaggucaacaugguguucaugaaugucauagaacagauauccacagaacccuaguaucuauuuugggcaaauuaguugcagccaucuccuugaggauucccacacugcacuucuagcugcacagcuagucugcaucucagaggguuggucauucagaguggcuggauagaaucauguccagaauugacuuucauugggaacaaggauguuagguuagagggcagauuaaggaaccuggaccagguguggugguggcacaugccuauaaucauagcacuugggagcagaggcagguggauuucugaguucgaggccagccuggucuacagagugaguuccaggacagccagggcuacacagagaaacccugucucaaaaaaaaaaaaaaaaaaaagaaaaagaaaaagaaaaagaaaagaagagagagagaaaaggaaggaaggaaggaaggaagggagggaggaaggaaggaaggaaggaaggaaggaaggaaggaaggaaggaaggaagaacaaacuuagaaucuucugauagguugcaauuuuauccaguagcuaugagggaucaggaaugccagggugguacuucuccuaaccacagugcuguacaggugaccgugcuaaaaauacagcaggagcaucacccaguuacuuagcaaacagguccugcaggcuucaucuaguguagagaacuuggagacucaggagacggugcccucagauccacuuucgcccuaauggaagggacagacagaccaagaaaccaacacuguaccauguuccgaggagucuacuagacagagcugagaguugcauucuaugcagagugcugguguaggagcaggcagggagauggcaggguacccagaaagugaucugaccuuaaugcugggcaaggaacugaguuaagagacaagggcacugucccagaagaauugcgcauguucaaaaguccagaaggcugagugcgggccaccaggcuguuucauuccagguaaaaagcugagcuguguaaggugcagaugcaucacagcacuuggguccugacugccaaacuccaggaaaccaggacacuagauucauacugaagguaccuacaacagcacagccacccuguaggaaagccagccaguggggccugauaguguaaucccaagcagcuugcccugcuuugagccacugccaacaggaaaccugaccaauagagccugagccuugcauauguuuaccuauuaagaaauuugggcgcuggagagauggcucagcggguaagagcacugacugcucuuccaaaaguccuuaguucaaaucccagcaaccacauggugacucacaaccaccaugagaucugaugcccucuucuggugugucugaagucaguuacaguauacuuauguauaauaauaaauaaaucuaaaaaaaagaaaaaaagaaagaaauuuggaagcuggguagugguggcgcaugccuuuaauccuagcacaaaagaagaaguuuggaaagacgcaacuuuccacggacuggcagcucauuaauguccuucucacaggucuuccuuguugugagcuuggaggcagaggagugaguauaacaaagaauaccaagguccaggccguagagcugaacugcacaccuggcagccuggagacucaguacacuacugcacaaauacaaaagggcccucuccucucuacuacccagagugugggcugggaggguuaugagcuggacagggagagguggcuuucagcaggcagagcagaguggccagcacucugggguaguagacacucuucagcauuggcuaacccgucagcuagggugcaggagaggaggguuauagagcucugugagugcuggucuuuugauccuuguuuucuggugaucucaugguacuggaggaggcuggugaggugauggcuaaggauggaugugggugagguaaggguugaauguacaucaacagacucauuuccucuucugcauccagcccuacagcuagcucaugugcugacucagccucccuuccugcauuagcugccauagccuccauugggcugcacacuugcugaugguagggccuuguugaccuugcuuccuaaugucuccccagagucuggacauguuucaagacauuugggaggcaugaaaccauggcuacaggucuguuugagccuauaacccaggugggaagcaaaggcaggaggaucaauacaaaucccaggccaguccugucuuacagaguaagcuccaggccagccuugucuacaguaauucccaagccaguccuuuacacaggaaguuccaggauauccauaucuacagaguaaacucuaggucagccuugucuacagaagaaguucuaggucaggggaguaauaauaaagcaagauccuuccaauaaacaaauaaacaaauaaauaaauaaauaaauaaaguggcuuugagaaacagacuuuuuagagugaaucucugcuuugcagcuuaccaaccauguagcuguaggcaagucugagcccucuguuuccccccacccccaguucuagccuguuuugaggggaguaagugucacuguguguaggacauccucaguccuauguuagguucguacugugcccagcgagcauguauguaaggaugaccuucccgacagcacucagggaugugaaagaaggguucagaaggaggggacucuguauugacucuuccucucacucugaagaauucgggucaugacucuuggaagcagagcuacagauaauuaaucaacagaaaagagagcuauuuagaauugcacugaagagcagggaaugggaucacaguuccggcuuggacagguaauggugccgguccagaguuagcccugucacaaaagcccuagcagcuuccggccugugcaggcaaggagacagccgauauggcaacaggaaggcaguuggucauagcuguaaugcuaucuguacuccacugagcacccacagaaugauuccaagggacaggagagcagggcuccucugggaccacaagggaaaauguccugccagggauucugggucaccgcugaagaugaacaguuuggaggcaagggcaagcacccagcaacuacccaaauacaugaauuuuggccaaggcuuauuccuucuuguugucucaagauguuccucacagccuucacaugacuucagauaguugacugcugaggagcuucuucugcuaggaagaaggcaggcucaaccagaucugacacacagacacaugacccauagugaacauguuugcguuaggagguauggucagcaggccagagccacugcccagaucaagucacuaaguugccucugggcagaacacaccugcaucaaacccaacacaggacuagcugcugaucccaggacugcuauccuugagcauuagcaagcuuauaacgauaacagagaccuccaagagcuaggagaaaagagccacugcccagcagcccuugaaagucagccagcagcuagagguagaggagucagcuaugcucugggaagcugguaaggguuuuuauucccuucuuaaaauagcagguuacgccaggcaguagugguacaugccuuuaaucccagcacuuggcagguggaucucugaguucgaggccagccuggucuacagagugaguuccaggacagccagggcuaaacagagaaacacugucucggaaaaaaaaauaaagaagagaagagaagagaagagaagagaagagaagagaagagaaggaaaaaagaaaagaaaaggaaaaaaaagaagaagaagaaaaaaaaacaaaaacaaaaaccaaaacuaaaaacaaaauagcaaguuacuuucauguuuaaaaacaaaacaugacaauccuguucucaaauuccacacuuacacgauaccuugacacaucucagggcaagucagaagagacugcaauucuucaccugcucagaugaucuucuuaccugugccaccaccuccucuuuuucuuccuucuccuguuuaggucacaguccuccuccucucugcuugucaccauaucuccaucucuguuggcacucuugcaagacuaauuagacuacuucugcaccugccccaucccacagcuuucccucaacacucacuggcccuuccacaugacuauagccccuuuugaaacuucagcucucuucccaggagaagaaggugcucaguuaccagguuugcagggccagugagagggcuaagagacccuugggcuccuggggcuaggggagcagaguacacaaccuggggaagaucaggaggaugcuauggaaugcuccgaccccagugagagcagggcagcaaggcagguaugagaaguuuguugcaaaacaccagcaccccucaccauaggaugcugguguuuuguuuuauuaggaguuuugauccguugguuaauugguugguuggguuuuuugguuugguuugguuugaaauaggaucugaccauguagguuuggauggccuuguuauggugacuagguucaccucuaacucacaaagaucagccugccucugcccccccccccccagagauuaaaggugugcugagauuaaaggugugcacuauggccggccauuuuaaggugcugaccccucugucuggguuuccuuauuagugagauggaggugguaguacacaccucuugaggugacaauuaaaucucaugcuuacuauaaccagcaauuacucuggugauuauauaauguauagcuuaugagguuaaaauauuacagaaggguguguuggccaggcagagacuagggaagaagaaaauggcuauugucagcagcaugacaaguaggaggaguggauauggugaaagagaaaaaaaauaaugaccacaguacaaacuuguaaggugggauugucagggaacugggacuauuagaggucugagcucaaggaugacucaacacuggccaucuggcugagggcagccuaagaaguagcagguuuuuaugguuaugcagccccuacccgcagacacucuuauagcucuuagcuauaacucauaaccagcucaaggcgacucuugaccucaacgugaggaguggugacagaagccacacucaguagauauuugaggaaagaacaugccuugucuuccagcccuucuaaagggacaccuuggccuccuccccuggccauaagccaguggcauggcauccgcccuucugucucagccuccugucauguguuuggaacauacuagcaccuggccugcugcaggaagcaaggguggaccaaaaggcauaccaguuagagagccagcugccugaccaguccagcaggggcauugcuggaagaaauagagcccuacccagucacauggagacaacccucauccccuccuaguccuguuaagagugugcuguguugugaggccuguuccagacaccauggagcaagaacuauaucuguccaccaggcaucucagugccuggaaugggccuggcuuacaaagagcugugguaagccaucaauagcacccagcuaugaagacugucuuccuugugugacaagugacacuagcauccaaacuggcugauaagcagguguauguguauguacaugacaucuucagccagagucugaaaacuagaggagucagcauggcagcugaggagaacaccaaguucucacccucugaauaugaaauguuaaccugucgcaugcuuacaugugauaaaaauacauguuugucaugccagccaggauaugacaggagguggaacaaaguugaguguacguguaaacagcagacauggcaguacauguguaugggccguuggugaagggcucacauuuucugaaccuagauucaucauucacauaacacccaucaauguccuuggagauggggucuuauuauguaaaauuggguuugguguauagcaccaguguggccuugaaccccuaccccugccuucuaaguacugggauuauauguaugugccaccaugcuuaccuccccauuacaagccuugagaccuuuguagcugguuccuagcucagaaaacuuacccuaaggaucacccagcgugaaagugguuccacagcguuaugacggaaccaggugaugacacaaucaaagauggcccuuuauguuuaugacuuguguucauuuaaagggaagaauugggcuaggaagguagcucagugguagagcacuugccugccaugcaugagauccuaccuucaagccccagugccagaaaaggaaaacaauaaugcccagcauucacugcacagccauucugagagagggccacuugaacacuggccacccuggaggcugaucuuucauuggcacagccauggagaaaaacauaaugaagaaaccgacuacaguggggguuguaagaagugagagccugaaaagggacagagaugguugcccccauugacuacuucuucuguguuuugaaccaugugacugcuuccaacccaaaggauacuaggaaguaaagaggagcauagcccacacagauaaagcuacccugucaugaacaagcccucugaggucaggccuggcuuaguucuuagccccauucauccauuuagccauucuccuuaucuauaaaagggcaaggacacuucuggccucauauggcuggcauaauucagugacaagugggacuacauauaagccugggugcccagaaagcaucugugaccuucugcuuuaucuauucccuccucacuccacugucugagucugaccauccaggacuccccauaccuuugugacucacaguuucuucacagagaaagcuacagauggcucccugcagagcgaggacugggcccucaacauggaaaucugugacaucaucaacgagacggaggaaggguaagggacccuuggggugagggguggggaugcaggcuaugacagccaacuauaagaguacacaccaucacugauuccugccuaugucccacuagaugauccucuauagcccccaacuguuguagccccaaagucuaacccugcuguacaauaguauccugacucuaucuuagacagcaacauggcacuuuaaacaucuuuagacccuuauacaauauagugccuucaucgaguggaugaaaaacuuagagauguaaaguucaaagucacuaugagacgguugguggugaugcaugccuuuaauacuaguauccaggaagcagaggcagggggaaucucugaguucaaggcccaccugaucuacaucaagaguucuuggcuacacagagaaacccugucucuaaaaaagacguagugugugugcagcuggccacuagggucacuagcugugacccacagugucucugaacaguaggccaaaugucacacagaucuagagcucuacccugggacaaaacgagcuggagacucauguuaucuuucuguaugcugaaagcuggagucuuggggcagcuggucucugagagcaagaacacacuuucaguuccuaaagauuagaaaccaggaguucccagagggcagcccugaaucagagcagagcugcgguucagaguagaugcccgcaggugaccagguauagggcccuaauguuugcucagaaaggugauuccagccaaaacgcaugguaugggagaagucuuggaguccugucuuccucuguggaaugggaccauggacaagucauacuaccucucugggacuuuuuccucaaaagagcucuguuaaauccugacaaaauucuagccuaaguccuuaacugggguagaaaguagggugaggugaauggguagccauggcaggcagggagggcagcuggaugaggccucugcucugguuaauccgaacauccucccaguuaagugcagauugaccaagaaggauaggaggcagggagugcacccugaacuucagggagacuguggauaucuuaggcuaggagaggaugguaacucugggccccaaccaaagucccccucagcugugcauuccuacgcaucugcaucuggacucaaagugagcguaaggugcaaguggacagauggcaggaccacuggccucugcuagggccaguaagucacugcaguagcuuuggagacaguguccugucuccauggugaucuugggaagcacagaguucauuugaacacuuuagguguuccagacucugcccacagcauggaggacccagccauaggcaaucagaggcaugacccuuggcuucagcaaucucaccuaaauuccugugccuuuggcagaaucauaccauugccauaugcuuuguccaugugugugcaguacauagucuacugcuagugcuguccccuuuucuccaggccacuucagucccuuucaaacacuaaaguaguccacaagccagucagcuuuuuauaacaaugcccuugagaugauuugcuuguaaagagaaauuuuuuaucucacuuuugguuugguuugguuugguuugguuugguuugguuugguuugguuuguggagcuaaagcagaaguuuuuauuuugucucagucuuaauugugcacaucaugaggaaugugugacgagcccacucacuacauggccagggaacaaaaaagugacagggacagaguuccauagugcccuucaaauucacaucucugacaaaaagagcauccagcagaguccagcucuucuccuaaccccaccccaauccagggccuugcacaugccagacaugcagugccauugaacuguagccucaaccuaagcccaccucaacaugucucaagagugccacugugcugcugaaaauucagggucuaaaccauauaacaguacugccaccaagaacugaagccagcugccgcuggaacuggccagggaaagacagggagccgucugaggugcucugaguacaggcuguguucacucuccugaucuugggccccuggccuucugugcuggggaagaaauuucuaaaccuaagcccauccuuccuuuuguccuuuuugccagccccaaagaugccuuccgagcagugaagaagcgaauuauggggaauaagaauuuccaugaggucaugcuggcccuuacggugaauauccugcugccucucucaucuguccaucucuccaugaucucuuccauggcuggaccguggucugcugaaagcugcuucuccuuaguuagguccagcaggauucccauccaugcuuggguuucucaccugaagacucagaagaaagugaccaugggcaaauuguuuuccuguucacacuguuggugaagguggaugacaaagcaagggagcuagaaaggaaauuuccagccuuaacauggggaguagauacacuggggccacuuuccucuaaaacugcacccuaaaaaaugaacguaaaacaaaugccugugucuaagaacaguguugaccucaguacuaagacaggccagcaugggccaagcaucagacauccugucuucagagcaacauggcuggaaaauaggcaggagaacacccuaucccagccucuacacgguagugccuagauccagauggcccugcgacccugcaaagcacaagcagcuucugcuaggccuugggaagaggucagugcuuggucccugggucaugauguuaccaaccuaaguuguaucugcuuccuccugaaucucuaagcuuccauaccaguguuucgaaauguaugggucacaaccccuuugggggucaaaugacuuuuaccagggucacauaucagauauccugcauaucagauguuuacauuaagauucauuaagauaacaguagcuccgggcguggugucacaggccuuuaaucccagcacucgggaggcagaggcaggcggauuucugaguuugaggcuagccuggucuacaaagugagauccaggacagccagggcuacacagagaaacccugucucaaaaaaacaaaaaaaaaauaaaauaaaauaaaacaaaacaaaacaaaaauaacaguagcaaaauuacaguuaugaaguagcaacaaaaauaauuuuaugguugaggggucaccaccacaugaggaacuaugucaaaaggucaaagcauuaagaagauagagaaccacugcucuagacgaugugaacuagaaaccaggguuagguuauaggcacuggccuaguaggaagggagucuugucuguccugucaugucccaguccccuaggaggcaagccuccaaauccaucaccguuuccauucuuauguccuaggggcucccuucuggaagccuccugucuucugcugggcuucccuucccugauggggcauucucuugggcaccuugaccuacaggucuuggaaacauguguuaagaacugugggcaccgcuuccauguacugguggccaaccaggacuuuguagagaaugugcuggugaggaccauccugccgaagaacaauccacccaccauugugcaugacaagguguugaaccucauccaggugugcucuuuggcaggguaggguguaucgguggccucaaggggugggggaauucuggggcuauucuacucugcuagugagcugcuuacgugugcagcaggacuuaucacugugugcugagccugguacacgggguuagaggaccaggcaacaggaggaagaggaggaaagcacucuguccucugucuaggugccagggucgggcaggcucacagaaaagaaggugagcagugguuacaggcaauguccccuuguccccucucaguccugggcugacgcguuccgcagcucaccugauuugacagguguuguugcugucuacgaggaccugcgaaggaagggccuagaauuucccaugacugaccuggacaugcugucgcccauccacacaccccagagaguaaggagaauuuugggugagaugagaauuauccugagggggcuacagugccuuuccaggaagccucacucacccugucuuuugccccuuagacuguauucaacucagagacaccauccagacagaacucugugaguuccaacaccagucagcguggagaccugagccagcaugccaccccucugcccacuccagcuguucucccgggugacucacccaucacaccgacuccugagcagguaaacagacaagccuguggcagaaccagaagauccagggaggugucagagauggccccuagcauuguggaaacuccuuugucuucucagcagcccauagauguguacuguucauccuaugguccggauaaggcucagacaggcaaauccaccaacucagaaucacacagcucaucagaaucuacugagauucaaguuccagucucucugacuucuagaaugcaguucaauacuacugucauuuuccaaagucuucccuccauggagcccuuuguggagcacuguggggaggaaauggccaacaggcagguguucccuuccacuugggccucuccacuuuaucuaugugcuaguaggcucacauagaguuucaucugaauugagauucaaguugaagacaaccauaaaagaucuguaugcuugcugggguugguggcaugccucuaaucccagcacuugagagacagagguaaguggaugugugugaguucagagccucugaucuacauggagacuuucaggcuagcuagggaugcauagugaaacucuugucauagaaagaaggugggugaggaagagagaucugcaucuucacaaaaugagaaauuuuauuuguacuccacugaggccucccacaauuccucaugaggaagcuuagaagcuuagcuugagauucuggggaaguuucucuagccuauggcuagcucuagaguauuaccaacuucagaccagguggcuguaaucuagauuauuggucauuugaggugugguacugagcugggcuugaggccuucucagaccuuagaccaucaccagugaaguauaaagacuuagcuggaaguaaagauucacaaacaugauacaaaugagaaacacuuaauucccaagaacuguucccugaccacuuguguauagugcauggucucagcccaacaaagagaagcuuggugcugucuuauaccacguuaugaaacuguaccaccacaaacaugacgagagcaggcuggcucucugagcauguaaagucuacaaaauuguaaaauuacucuaaaauccaaaacaaguaucuaucuuguuucugauuuuaacuaguuuuucuaaagucuguauauuaagacuaauuagugcuagaagguucuuacuaaguaaaacugaguauucuuguuugauuucauagccccuuuggccucuugggcguguuaggaugcugugguguggugauguaauuccuaggcuccuuugugguuagaucccuuuggguuuggauggcaagcuggugaugagcagcuuguucacucacaccaggaguuauuaaacaagccguugugccuggcacuguggggugugcucuuggucagcuucaaugggcauggauggugcuugucccugcgugccuguuucuucaucccugagcuccauaaaguuagcccaccugugauggcgcauguucagugcuuggcgcuuauuaacuagucaggaaaugggagcugcugucacagucaugaauuuaaauucugaaguuuauugucacucaaucacacaauuuagaauauaccaguauuuccccaaauguagucuccuagccacuagauuuaugagccaucccauuauaagaggauucuucagccagguacaucugggggguggggguagggagcagugcuucaucugcuucucaguauucaaagugaacacaguguccuccgaguucauaaaagacacugcagaguggcccucacaccucaucuguuugaggacacugaccaccaucauugugaaccuuggcucuuuucgaucacugguacuaauucacauggguaucaggccuugcgcuuacuuuuggauaaaccugggcccuaaagaaucugaagguaaagacacagacaaaaccuacucuguccucccaggcauaaggggacucugcaaccugccuuccuaauccuuaggagaaccaucccuagggccucauuaauugccaucuuggccccaagagaugcuggcacucuuccaaccacccucacuggcuauuccccuccgauugucacacgacuuucaacuugccucuguuccuggcuccugguugggagauggcagcgguugguagcaccucugugaggggcugugaagugggaggaagcuucugcaggcucuugauccgcaggagucaggagggaagcuguguggagaaaguguuggcugaauagugccugggccacacgacuggaggaggcaugggcucuagacucuggcuuuucucccccuuacaauggugcauuucagauugggaagcugcgcagugagcuggagauggugagcggaaacgugcgagugaugucagagaugcugacagagcuggugcccacccagguagagccugcagaccuggagcuacuacaggugagcaaacagccugccuccagguucagcccccaccaaagugacccugugugcagccacaccuguuuccucccugucuacauugcaguccuuuguuuuugcugggagcucucaggcaauagaaaacauuacaaccaggaaccugggauuugcaucagacaggaauucacaucuuaauucugcugcuuuaugacuugaacaaaaccaccccucguuuucuccaucuguguggcugcuuugauacaagcaggacaugagaguuaaaggagauaguacaugugaagcaucuacuccuccgcccaguacuggugagcacagacaacacugggaaaagccagaagggccgauucccacccgucacaguguuggcgguggcaaacaggagggaaaaagcagugugggcuuugagaggagugaccauccauccagucuuggggagcugaggccagugggaaaugcuggauuuugcuccugggugucauaugauagucaccugauccugucuucauauggaguggggcgcaggacugagggggguuuaggcagccuuccuguaggggacacugaggaaggcagugagaaagucaggaacugacaaagccagagucuccagaauguguagaaggacagaaugcucugugugcagaaugcucugugugcugucuguaucgcccucccaccaacccucagagagcaguuuugaagccaggucuuuaugccccugugacugcucagagauccuuauauuugggggugggggaauaaaguaggaguaucuuagcugaguggacucuuugagugugagaacuagaugaagaaaggagguugacuaagaguuguuauaguguuauaugucccaagccaaguccaugcagauaugaguagucugggauacucagaaggcuggagccagcugucaaggugacacagagucagugcccacauaaugaguacucuuuguaucaagcucaauguaggugcuugauauacauucauucauagccuaaacaaacccauucuccagaucaggaaacuaaggcaaagagacuguaacaugccugugguuacuguggcugguagguagcaaauccaggguuugugacuuguagcaacgacuucagucuaggcucuucuuguguccagagggaccgaugaggaagcagaaacuaaugucaguuauacuucaucauaggaggaagagaaggggaggccagagauguugaaagacucccugugcagaugaagaaaccccaggaggccugggugggguggguggggaacaagguccaugaaaagacagagcuuggugaagugccucaucuuugaugcuacaagagaaagugugcuggcauauccauggcaggugcuggagaaaaggugaccagucucccuacaguugccuguagaccaaaggagguuuauuuuacuuacuuauuuuuuaguaaaggucucaugaugcagccaagccugguccugcacauucuccaucccccugucucagucccugacuauacgggucacagauucauagcauaacacccaaccucuuaaucuuuuucuuuuuuccaaaacaaguuuaacugugauuaaaacccaaucaguaacauggugccuaaauacauguaggaucuagaaacaggaaacaaaaagauauuagcaggaaacguaguuuaguugauuucaguguugaugccuugguuuugacaaaugucaaacuggguaaaggcacaugagaaccuuggugccauauugcagcucuucaauaaaucugaaagauuguuccaaaauaaguuuuacuaaaagagaaaaaagccaauccaugagaaaaguggggcaaaagcuugugugaaguaacagagaaguuaaacguguucacacccgaccccauccucagguccgucauccuccucacccuccucacucuucuguuuuccccuuaggugugcaucugugacuguggugugugugugagugagacauggcaauacuacagcuugcuaucgaaguaagagaucagccuuagggagccagcucucuccuucaacucuguuugaggcagugucucuccuguuugugcuacuuaccacaugggccagacuggcugguccaggaggcugagguuuuucuaaguaagcaaacgugguggcuaaaacuugacucugcagucugcacacaguccuguuaaagcagcacagucauuaucaggacucaguccgguacuuuacauguuauugugaagccuaacacuuccagcuacuccagaaguugugggucaccugaggccaagccuaggggacagugagagcccaucucacaacucaaagacuguaaccacacugcagcaccugagcagugaucuugagaacaggcuuguggagccaugaagaccccucuuccaggacuguugaugaggaguagccuuguccuucguguggccucaaugucucgcuccuccccguaggaacugaaccgcaccugccgugccaugcagcagcggauccuggagcuuaucccacgcaucuccaaugagcagcugacggaggagcugcucaugaucaacgacaaccucaacaacguguuucugcgccaugaacgguaguccugccacaccuucaccugggccguggccucggcuacucagucauuuucccugugcccuuuucagacaucagcaagcuaccagagcccccagcucucuccccgucacugagcugcuuggguaguggguagucauaaaagcaggaagcaaagugcucugcucuagaaaugguuauuaucuagccaccucccacuccuugugucuauuguguguuccccacuugcugugugguuugcagucagucgagaggggcugggccccugagggcaacaguuggccaguuuuuccuguucacuagcccaagaggaugcacauccucuccuccuugccaucuuguuuuguuuguuuguuuguuuuguuuuguuuuguuuuguuuuguuuuguuuuugagacaggguuucucuguguagcccugacuguccagguacucacuuuguagaccaggcuggccucgaacucagaaauccaccugccucugccucccaagugcugggauuaaaggggugcgccaccaccgccccgcuccuucuuugccaucuugaggugcacugugugguagucccccaguucucuagcaucaggccccuaauuuaccaguuuguucuggugccagccaacugcuacucagugccucaacucagucaucaccucagcuagcaggcaggugcccagagacauuagaacagaaaaugaauucaaaagugauguccuuuauaccaggccagaacuccaacaggcuggucacuaaggucuucuccaccuaccucccuagccccuggccccuaaguagucaggguuagagacaaguggccaucuuugagagccaaccauacauucucaaauguagaguaaguaacuagacaguugacaaagcagugcucaacucugcuugcugagugucccuuucuuuuguguuccugugaccuuguuucuugcugaccauugcaaaguguuccuaugagugaucaaaugccucccagcccugugcaagcgaaacaggggcucugcuagugauagcaugagaacagcgagcaugcgcugcaucugugaggguagaccaguuaucuccucauccugguaaugaucugggguccucugggaacuguguccaucuguucuuuuugacugggguauuuucugucuuguagguuugaacgcuuccgaacaggccagacugcuaagguaagaggcaacucuugugggacugugucaugcuuuauugauagaagugagagggaaguucucaccgucucccugaugccuuccuuguaaaggauacuggugcuucuuuuuaggcucauagggaagucucugacuucuuacaccacuaucccuuuaagggaaauaaggcucugccaccaccaguuuguaccucagggccuucccagccucccagggguguagcugagcuggagcccagguggaggagaaaguccccagcucccauucagacauguuggggccuggaggcagaucucugcauccugaaagguucauccaggcaucuccccucaccucaggccuccagugaagcugagcuagcuacugaccugauugacauggguccugaccccgcagccacaaacaaccucucaucucaacuggcaggaaugaguaaguaugcuggggacuccagccaaggguauguuucaauguguggguagcuucaaaguuccugugcucgccaacagcagagcauugguccacaucuuacuuugcugggaucccaagccaaaucuugcuacaggauugggcaaaacuugugagaaugcccugggaguaccaaugucccugagccccuuggauaauauaaaucccacugcacucuaaccaucccucugcccugccuccccauccccuccauccaccccaccugaacauccuggggaccaucagacaaucgacugcucagccucaguaaucacuuccuacuugaagaaggaaagaaggaaugggccccucuucaagguuggaagaauagagcaagaaacugccagaaagcggcuucuaucagggcgaggccagaaggcgcuccguuccggugacacugcaggauagaacucgggaccuuggccaugcuagacaauauuuuugccacugaguuaaacuccagcuugguuuccuuuggugcuuuguucuggggaaaaaaaaauagauaauuuagguuugauuugauuuugcuggcuuuugauccagguuguugcuaagugcucaguagccugucuagguaggccucaaacuuucuccauccuccugccucagucucccaaaaccugagauuacagguggguauaccuguaauauuagcagucauuaucuuuuuuguuguuccugggcugcuacugcugcugcuguuguuguuguuguuuauuuuggguguuuuguuuugugcuggggauuaagccucaagcuaaacaagugcuuuaccacugaacuauauuccaacccuuuaauuuugagauagggccucacaaauuuccccaaacuguccuugaaugugcuuaguaaccuaggcuauucucagucuccccuggagcugggcuuacaggcuggcaccacaaggucugcuuacaauugaguuuaauauuauugacugccugcuccacgccaaaccccagaaaugcauucugcucccacaugugugagcagucggaucugagcacuguucugcugcucagccucuuccauuagcucagugguucucaaccuuccuaaugcuuuaacacgguuccucaugcuauggugacccccaaccauaaaguuauuuucauugauaauucauaacuguaauuaugcuacuguuaugaauuauaauguaaaugucugauaugcaacccugugaaagggucauucgauccacggguugagaaccacugcucuagcaggugauacaggcagggauuuccuguuuucuaauccucaccacagcgggaggaggcggcugugguaccacuuuagaagugagcacacucagcagaaaugaagggcuuccuacugcucucgggcaguagucggcuucccauccaaaucccuccaccucaccccuaaugcucuucaagcaagcagcccuagucccagauggaacaugggaagagcaaauggaacagcaggccucuugccuggcccuucugucucugcagaccuuggcuccagaagugugagagcuggccugcagucucuggagaccucaggucaccuggaagaugacuuugacauguuugcucugacucggggcagcucacuggcugaccaacggaaagggugaguuaccuguuccauccugcucuccugagggggagggcucucuguugacaagagcaucucuugagaucccugaaucuggaauggaaaugggcagggcaggagaaaagacgcacagucccuaaguucaguccagcauggccuggauaacacugugguucagggacaggaagggauaccaacaucugaccagaaccagaagcaaaccucugagggauuggaagguugggagccucugaccacuucuacguaacauuuugucuggcuggcccaccaucuuccauaaugugcagccaguaccaagcccccaggggcaaggaaggcuccuaagaaagccuuagugacuucuagguuuugacuauugucucauaaccauccuucaucccuagagaagacuccggcugcacugggguaaagccuucccugugagcuguccauuuucagagagcuguugucaucagucagacccuguaauggagcaggccuccaaaggcacucccugcucuggcagaucucauacuagcuccucaugugcucgucaaggaaauagcuuagcugauauuuuucaucccuuugcuuguaacccuguuggcucagcuauguggaagcuaugguucuuacagccaaggaaaguucuagauuaaaaaagccuccuagcuguucccacuuagugucuuagugccuauucuuucuuugacaacuugguuauuggacaguagaaacuggccagagaggauuuaggccagacugggguuuaggaagcauuucagguucuaggaacaggaaugugaaggcuuggaggcaaggcagaugagcugagcucuagcccuucacaggcacaugucuguguauaggagcagaugcugagaagaucacacaacaguucuucccuuugacugguguaacuucccugagcccccuuaggccuuugguuuuccucacacuacagauucagguacaaucugacgcagucugcagccagccaguuccacacuaagcuguaaaccagguuugucuuuucccucagcagucuguacuccccagcccagaggccucuggccuagcagcuuacgauagccaugguauuaaggaugcugcugaggcugcugugcagaugaaagcuaaugagucuagugggacccacacucaggaggauggaguguccacauaggcaccaguguacaaaacaacuaggcacacuggagagucccgaguguuuaacaggucugacagcauggcugggguacacugcuucaccaccauaccuccacagggaaggcacacaugcagugguucuuuuuuuuucuuuuuuuuuuuuuuuuuugguuuuucgagacaggguuucucuguguagcccuggcuguccuagaacucaacucuguagaguaugcuggccucaaacucauaaauccuccugccucugccucccaagugcugggauuaaaggcgugugccaccaccgcccggcacauguaguaguuacuguguggaggagcagguagcccuucagaaggcucaaggccagacugggguuuaggaagcauuucagguucuaggaacaggaaaugcgaaggcuuggaggcaaggcagaugagcugagcucuagcccuucacaggcacaugucuguaagggagcagauacugagaagaucacacaacaguucuucccuuugacugguguaacuucccugagcccccuuaggccuuuggucuuccuguaccauucacugugcauugauccccacccuacagaaugcacccacagagaucccacuucugugggcccuagcucugagguccuuguuccuuuguccuuguuccugccuaacccaccuucaugcuguaauagacccucucauucuggucaccuggcggacuuuuuuugcccagauaguuuccuugcccucccaaccuccccauuccaugccagccuccagcuggcucugccaggccucacaaggaagccagcuuuuugucaacgccccuguuuucauuucagcuccuaccaaauccaguaccacagccucuccaaccaggccuuuguacuuggaguacaaaggaagacaguagaggccugggcauccuggucaggaugcuccucccuuccauccucucuacuauccuuaggagccuuauccuuccucaaugaugucuacagagcagccucuucagaagcacuuagacaaguacugucccaagugcccugagauucagcccuacucagcaaccaauaaggacaaccuggguagagacucccuucuuccugcccagucaugggauggucaaauucuagcccagggucuguagcccauaaaggucaaguuaggcuuuccaggggaacauacugggccuuucaaauagcuaaguuuucacuguaagacugaggacagggacaugguggucaggaguaauuaggaaaauagacccagucucuggcaugggugccuucuugcugguuguccuggcucagacuuaguuagagaugcugagccccauagugcugauaucaacaaccugcucuucauguaaucaggagcuguguggccaagagaaacaaaccagccaguccuguuugugacagcugggccucccaggaagggagugacagcaucauccuuggaauggcugucagggaguuggggcuuuuauucaaagauccuccuagccacagccuacacagcccccagaaaagggaaucagcacugcacaagcccacugugaugcagccucuauugcuaaagucuuuggccauagcagaguaguggggccccaggaaaggaacuccuuuccacuccugacagugcguauuuuccccuugggauagaaaccggguggcugcguucaucaccuccaggcucagcugaccaggacagaugagggccagccucccucccacuucaggaugaccucucucuccccugaggcuauucucagucauaccacauccucuuucccucuccucauuugccaaagccagcagccuuccuagcccuggccuucaguugccuggcuggcuggccccccuuugggcuauuuaaaagagcugugaccaguccaucaaagagccugggagugucuuccaauagccagccaaggucagauaggcccuuagcagcuugcacacucauuuuggcaguagaagaaacuccccuauucaaauacauccuuaaacagaaccacaguugaugaaauucaaaugggaacugcucaaaaaggaaccuauaaaaacuauccaugagcacgggagucacaaucuaucuccuaguccuucaacuuggucuguuguggucacaaccauguaugagcuuauuccugggcuuuggucacauguugucucuagauauucucucucucucucucucucucucucucucucucucucucucucucccucccucccccccucccucccuuucucucuuuuuuuuuuuuguuuggucuucgagacaggguuucucuguguagccuuggcuguccuggaacucacucuguagaccaggcuggccucgaacucagaaauccgccugccucugccucccaaguucugggauuaaaggcgugcaccaccacugccuggcaucucuagauucucaugcuccguugauguaugucauuauggggcacauauaugaacauaaucuuuaauagcaaaaaauggagccuccucuuccugccccaugcuuggagaggaggagccucagaccaggacauucugugaccugagccauuccugcccaggccaacccaagucaggcucaccugauacccucaguccuuacgcugccuaucaggccugguguggucaagcaacgucuaaugucauacugcucuguauuucagggucaaauaugaagcuccccaaaccacagauggccuggcuggggcccuagaugcccggcagcagagcaccggagcgguaagcaaagaggaucuguucuauccagagccuuccaaaaaggagggacuuccagcacuggcuugguacagcucuuuuccauuuggcucucaguuggcccuuuguggcuagugugauuauucccagucaagagccaaggaagcacucacucaacaagugacccaauccugcuucagggacuagugucagugugguccuggguucacauuccacuucaucaccugccagcuauggcaguuuugucaucuuuaccuggaacuccuaacagcaguggacaugcacagcagccugggagagggcagcacucugucauuguuccccaucacuccuuucacucacaggagcaugagcagaggggagcaaaagcaacccuagaacaacagucagaauucccacacacacucuuuuaaguccaguuaauuccuugacuauguguuaaguggcagcccagaacugaacccucuauggcuguccuccacaguggcaagauuccaagcagaauccauagugagccaagccacugugagugagacaucuagaaauagcacacuccucucagaagcuagaggaggagaaggaggaguguagaagauggagucugaggccacguggugagagaggugccugagaggugggaagaggucuacgaggugucuaggaccacggacacuauccuagcugagguagaagcuauuugaaagccuugagcacagagguccugcucacacagggcaggaucuggugacucccaggaacucuccaugugugcuccuguaccuccuagcucuuugcuuggagucccuuucagagcagaacaggcacagaacacuuuuggacaggcagacuucauagaguccaagggccucuauugggugcuucggcgcacaccugcucugggccucucuucugcaugcuuuugagccaucacuucuugagccuguucucuguguuuggcucugugcuaagcccucauguuccucuugugggaaucauacacuguucacuccugcugccacacagaaauagagguaucuucccaggacuaacagcaauggcgaggaugagcaguguugaguuuccagguucccacagcgccguucaguagcccacaguggacaacacaggcacaguugcccuugcugaccagcaugacugugcauucacuccccccacccuuuauucgggcagccaccuguuggauaugauuucugaagaccaagccagcacccacucccaaaggcuugagucugucuaaaggcaaaggcacauaacccacugacugugggaugguauuguaaaaucaaaauccagacuggagcuggugggcagugccuuguccaaggcucagcagaacucacagccugugugauggacaagguucucuuccuucacuccuuggugcugcgguaggcuaagccuacacugguuaugagcguagacauggucugacauuaaccucagggcacuccuggcaucuuacauaauguucuuguaguuuucuuccucaccuggcaacaugacugucauccaaaguagacagaggggucaaugcauaauggguaggagccucgccaccacccuccugugcugggaccuagaaagguuccucuuugcuguuguuaacuauaaaaccgguggacaaagcagucuuucuaaaaccugagugccccuuagaagcccucaguagucaccaggcuggcugacagcugcugcucuucagcuuagagugugugggcuacccuuuggggucccauagaaauguggaggaguguuuugucuuguuuuguuuacuuugcucuccacauugccccaaccuggcagcuucuggguauacuccucagccacaccacauacuccaucccuguccacaucuuccagcagccaggugccagccacaccccuccagcccuggccuuucaccuuccuggcuggcugaccucccuuugcagacauuuaaaagagcugugaccagucagaaagguagggagugucaucaugauucucccauagugaggcacccuagguagcuuaggugauaagcuugggcacuaaacugguuuggucagagacucuagcucucccucuauuccaaagcugucaaacagaaacuuaaguucccagccuuccucuauacaggcucucugcuggccuuacugccuccugacagcgcuauggaugauagccauguugccagguaaggaagacaaguacaagaacauuguguaagaugccaggaguucccugagcuccauagcaggccacgucuaugcacaugccagauugacacuguugaaacuguuacagaggaaaccaacuccugcuccuuuuagaaaccaccaugugagagcccauguguuugagcucagagucaaauacucccaucuagaaagcugccccuguaaccaccagccuggacucucuggaacacuuggagccucccuccucuuaaauuccuauuucuucucucucucucucucucucucucucucucucucucucucucucucucucucucucucucucucucucucucucucucucucucucucucucucucucucuuugguuuuuugagacaggguuucucuguagcccuggcuguccuggaacucacuuuguagaccaggcuggccucgaauucagaaauccgccugccucugccucccgagugcugggauuaaaggcaugcaccaccaugcccggcuuaaauuccuauuucugccauuaacugagucucccuguuugcucugagcaccugugaccaggcuuguccuuguccugaaccauggcuuaaaacccuucuccaguugaagcaccucccucuguuggggccagacauacauuuucuccaugccggaaaugauccuauuuaccccuugugcugcuccugcugcuaggcagaacggucucaggcagcuggaagagguaaccccaggaucugcaccccauuaggacacgaaagcaacucagaucgggguggaugagggauugaggaagcguucagcuuccuuccugugacucacccacugccucccugcugccuuccuuccagaucccagccacucaggcccgcaucauggaggacauugagcaguggcuguccacagaugugguaaguuggggcucacaccucuccugccaagcagggauccauuugucuuauagaagggccuuguaagugacuggaggagaggcaaguauuacugucuucaucucauccccaccguccucucccacgcaacagccuuccuguuccaggucacacucucagcgugacuucccugugcuuaucagagguggcauugguuauggacggaggcagggguuacuaaacuccccucaguaggcccucagagggaaguaucauugucccauucccaucaaaaaggcugguaacugcaaggggcccagcucacagcuaccacuuucuaaaggggcauuaccagaagacagaaauccugaacuggaccuccagccccaagcccugcuucugccaccacuucuguggacacugaagacccaggagagcuuggacacuuaauuucuaaaggcccuucugaggcagaugucucauuccaacuccaugccccacacauccaguuggguagugggucauaacuuuaccuccagccagauuugaggacagcuguaacacaagcagucccugagugggggugucagccuuccugccuucugucugugaacccuggagggaggaguguacugcuaggcaucauuccuggcuuugcguguggucugugcuuagcgucccacauccaugagcuuagccuuggcugcacuguuucuccuccuuuccauccgucuguccuuccuuccucccuuccuucuucccuuccuuccucccuuccuuucuuugccuuuuugagacagagucucuaucuaguacuagcugucaacuugcuuuguagacuaggcuggccuugaacucacagagauccuccugccucugccucacaagugcugggauuaaagauaugugccaccaugccuagccauucucucuguuucuugacauuuaaguuuuaaaaaaagauuuaacuuuuuacaaaauaaaagacauccgcuuccuuggaacuagaguuacaauucauaugaacugccauaugggaacagaacccagguccucugcaacagcaaacugagcccuuaaccacugagcaagaucgccaguccuaauuuuauguuuugugucuaugagugagcaugcaccuguaugggcucaagagccguacccacagaggccaaaagaaggcauuggguccccugcuucugguauauaggcuguuaggagcugccugauaugugugcuagaaacugaacuugaguucacuguaagaauuaguaugagcucuuaacugcuaagcuauuucuucagggccagucucccuguuucaaaggagaaaaaaaaaaaaucauggcugagaaauuggaacaccuggguucugaagcauaggagguuucaacccaagaccucagaccugacaucagggucagcuuaaggacaacagcaacacugguccugaucccaaggcuguuccacugggcguccaguucugcaugcuccuggcaguaauaaccucuguuucuuucccucugcauucucaggggaacagugcugaggagcccucuggugucaccagugaagguaaccuccaccccaucugccugccccugccccugccccucucccacccccuuuucuccccuucucccucccccucccccagcucuagccuacaagccuacucuuucccucuagaauuugacaaauuucuggaagaacgagccaaagcugcugaucgacuucccaaccuggccagcccuucagccgagggaccccccagaccaucuccuggaacagccccucggaggaagacccaggagaaggacgaugacaugcuguuugccuuaugaaugcagggucuggcauccugcagcccagggccugacacucucauacccacuggggccccucccucccuugguauuaaagcugcuuggggguguuuuguuaccccgcuucucuucucccagagccugggcagcaagggggucaacugaaggaauaagucagcccuccacuggaauccuggcugguccugccuucuucccauccugcuaacgacuaugauuuuacugagaccuggggccccagacaagcugaccugauaggaccuaauugaccugguguaaggcugcuucugugauauuccccuggucccuuccccagagaaucccacgggagcccuccagacucuacacuaacagucuaggcaauagaggagacauuaccacagccuugccuaucccaucccccugcagaguggggcccgaaaaaagcuucaguggcuuuugggaugggcuaugguggccccugcugagcugcccacuguccugguacgaaacugcacccaucgaggaaacaucucacugcccaggugucaagaugagaccucgaggauucuggguacccagagcuccccaguuccuccacugccuuuccccuauccuugcucuguaccuccagcagggcuccacccaccuggggcucaccuguugauugguccucagguacagggagaggugccuuuuguauccccaaauaaaaguagaaaaccaccugucagcaug

SEQ ID NO: 12148 - RNA, 1818 nt, Mus musculus
uuacuuaaauagauucaauaaaaagucaaacacacacacacaaacacaucuuaaaauagacuuuagacacgaagugcguguuucuucuccacaguacuaugcagagggggagggcagggggcggaggucccucccuaguauccccgcaggcugaguaccaagcggcggggccagcuccgccgcgacagcccccuucuccccucccuguuaaauacacaaauauauuauauucaauaugaauucagucucuuugcagaaaaaaaaaacauacaaaauacgcuggaagggggccauguaaaccucgagguggaaggacugggcgcaggcgggcgggccggaguccagugugugagcugcgccccaggccuuuuggcgggugcccaucgccugccccccucaccccaguggggggcaggcgcccagccuucaaggcuggggguguccguauggggcaagggaggcucucagaaggcgugucccuugaccccuagcagcaacuggcagccguugcugacaugggucaugaccuucugcuugagcugcgccacuugcucccguaggagaccggcagcacucgacagccccgcguucucagccuugagugucuucaccuuguccuccaggcgcgcgaugcgcuccagcuuccgcuuccggcacuugguggccgccagccuguuccgcagccgcuuucgcuccacuuugaugcgcuccuggucuuccauguugaugggggacacaggcggcguggcgucgcggcugcgugccuccgguacggucugcgguuccucuuuaaaggcggaagcgccgcgacucaagcccagcugugccggguggccgcccgcaaaggguggugcaugugggagguagcugaugguggccgucggguaugagcucccagucccgacggcggucccggagccuccagagggugcagaggcuggggaguaacugcugagguugguguagacgggaggcggcuccggaccagcauagacgcccccugggccggccuggggacccccgcuggcgcccagggacacguuggggggcgucacgugguucaucuugugcaggucguccagggcuuugacaaaaccguccgcaaagcccuccugcuccucggugacgccgcccccuguaccuccaccgcugccacccccacggggguaaaaguacugucccggaggcgugggcgucgucgugaucacgccguugcuguuggggacgaucaagcgcuccaguuccguggaggcuagcuucagagaugcgccugugucugaucccugacccgaaaaguagcugccugccccacugcccuccgggccuggaccccgcgccccaggacccuugagaccccgauagggauccgccagguugagcgccaagguggguuucaggaguuuguagucguguagagacaggcugccagggcuccgaccguaucccgccgcugcguaagagucgucgugauagaaaggcuguuccauuuucgugcacauccgggcggccugggcgaucugggaaaggucccccugaagggccgccccgggccucgcugcggcgagcggcgagcuguccucggcuguggcaggacccgguguccggucgcgcguccucgggagcuggagacggucagcagcggccaguuggcagcugugcguaaaggcgcugcugggcuuccggagauuuucucucccuccguggugcgccugcuuucucggcgucgcuucccucaguuccccgcucccagcaggauccuacgcuggccuggccacccucaaaguccccagugcucggccccagccccaagcuuuuaua

SEQ ID NO: 12149 - RNA, 54919 nt, Mus musculus
caguucggaggcggggcaggugggggcgggcccagguagcagguucggcugcgcgggggcccgcgcgccugagguaaauacuggggugguggguguggggcgcccggccggcccgggacgcugguucugaagcccggggcugcggcgcugagcggcggccgaggcgggugagugugcgcggccgcgcggcugacgcuagguccccaguguuccugcucugccucaggcgcccugaagcgcggaggcgaccgucgggccucagcgcccgcccguuagcugccccgggccgacgagcuucugacgucaaccgcgguugucaccuccagccugcccgagggcucccgacucgcgggacuccugcaccacagggcuuggguaggagcagugcaggacuccgucuuucucucuggcccgccgucguggacagauggggaaacugaggccgggacccugccuggcucccaacggcugcaggaggcagggagaaucucggguuaugguaccucacgucugugcuguuuugugggguguugguggcuccgcucccggaagagcagucuggccucgcuaauggcguguucugcuuuuucuuucaguuucucuggucuggagggaggggggaggagagaggaugguuuugcacaguuguguaguuggaaggugcauccuguugagacagguaccuuguuuuuccuuuuauuauuauggucagccuuggaggagaccgccaagucgcgaaugaucauggucuggaacugaguucaucugggucagcugccagguuauucauguccuuggcaucuuuuucuauuccaccccuuggcauuugcauguuuuagggguuugucauccucuagccaccaagccuugcaaucucccaacccccacuauccccgccaccuuccucuuuuugauuuucccuggaaaguugucuccuuagaggagcauucauucauaccuugcuguggugugugugugugugugugugugugugucugugugugucuguguuggggcuaaucagggauuccuaauaagauugcucauuuuuguaaucauuggcuccagagaagaaugcaggcaucaagagggcgugcauucaaacaucagucucuugcacacccccucauaccucaaguagguugaauggccccaagaauuuagccugcugcuccccgcuggguaguggguggauuugcacuagaacaguauugaaggaaagugauuugcuggaaauucuuagugaaguucauguaauuugaauguugacaguacccagaacauucucuaauguucugcugcaaaauuuuaagguauucuuuaaaaaaaaaaaaaaaagccuuguuuggacuggaaacuuuugagaugagcugauaagaccaggaacuuguuauguaaaaaugacauauuaaacagaagauaccuaaacugugguuaagugauuuaaggaagucuuuaauacaugaagaaagagcaguaauuauccugcccaucaaucuauacuuaguguuuugcuccugguguuuauacugucaucuuacauuuuuaguuucaaaugaagcuccaaacaaccugguuucauaauugugacauuucaccuuacuuguuucuacuuauauggauaguagcauaguauaaaauugauugugauuuuuuuccccagagaauuaaugauauuuuaggcaaacaucauguuucucuauuucuugacucuuauuuuuaacauaguagaaacuucuggucacuuaaauaggacaaggaaauagcauuuuggcuuccaccauuacaaucuaagcuaaucaaguuuucuggucuagucccuggaaagacaaggaguggggaagucacauuuuuagagcccagugguuagguuuaacucacaagagacagcauuguuccugucuuccugaugugacugcagaugcaagagccagacuuuuuuuuuuuuuccagacuuuuuuauuaaauaaaccuuuuaagucccacuugguuuugugacuguauccucgugucacaaauuauucuggucuugaaaucucuguauuucuauuuacuguuuaggcauguaaugacuuguucuuuuaguaagaguuguuuuuucuuaaguuagucauucuaacugacugaaagcauuuggagaagauguggcucuuuucuugcauauccaugccagccugcuuaccucuuuaccauuugugauuugagcaguauuuaguauuguaauuucuauugugauuuagaaagcuuucugugguguuuuagaacaaggaggcuaccucagaagagccagaugugauugaauuacaccugucuuugugagugucuuggggaugguacaucuugaucacuugagcauccagauguuuuagucuagaaaaauuacauuaucgcuuuuauguagcuggugaccauucauauugugauucuuaaaaccugguaauucugaucauuaauauuuguuguaggacuugcauccuguucaucuuaucauuucauucacuggaaauuguucaacauuuauuuuuuuaacccucauuuaguuuaauaauuuuuaucuuaacauaauggaacccuccuuuacucagcauucaggccgacaacuugcucauaagcagauagauucuuuuuuguucccucgucuccaguguccccaagaaaggccuccuuucaucuuugugucaugcugaacaguuugaggcuacauuguugugguccagcucuuugauacucuucuuucaguauuucaguaauuaaucaaaauauacacaauuacuguuacccagucagacaugggacaauguuuagaugaguuguuccugauauauucaccuucacaaugauuccauuugccaaguaacucgagaguauaguugaaaaucucccccuucauacucucucucuccucauuacugugaacuuguugucuaauagcagucaugaccugcacuuaaagcggaagcugaauggguggaaagcagacaucagcccuuaaaguguguaguuuucagggucuacugacuguaucagaauauugaacgugaucuggaaaaagcucacgaugugauuuugauguuucucuuuguagagucuugagacaguucuuauugcuugggguucuaaggcuuuauuuaacuacugugcagaucccagaggagugagaauguugguauuauauucauuacuacaggaagagaaaagaugguuaggauauuucuguugugaugcugauguuuugagaugauaaaugaucauuugguuuuucaucagguauguguguagaaagagacaaaguucucuauucuauuuuauuauuuguaauaaaggaaauuaauuuuaauguguuucaaacauacuuuuuucuuuuuauacauuuuauuuauucucguuuuuauaugcacuaguguuuuaccugcaugugugucugugugagggugucaaauccugggguuacagauaguugugagcuucaaugugggugcugggaauugaaucugaguccucuggaauuguagucagugcucuuaacugcugaaccaucucuccaacccccugaaucuuauucuugauauauuccuuuuaaaagcgggaagguucacacgucucuuucucuuuggauaauacuuuaaaaaauauuuuauaauguuuguuuugacuauuuuaguugucuguuguaccuauucuauuacugaauauaaacucagguucacuugugcaacaaguugcauucaucauucuuugucuaguucauuuaaaaaauauucuugaaaaguucuguuuauugccauagaccuuuuuacaaaccaagcaguuauauaauucuuaaaacuguguacuaucuuuugagaucaaauucauuuaaauauaauguccugaaacauauacaauuauuuuguuuugauaauguuucauuaacacuaauuuuuuuaaacuucaaauuguggcauuaguuguuaaguuagagagaguuaauagaauaggcagguaccaauuuaccaucuaaagauacccaguuuuagaaauuuuagaaauaaaaagaauuauuuuaaaaauaaaauagcuaugaaauguuuuuggucaaaaauuuugaaaugcauuuuaaagagaccccaaacaauaacuugcugcuuuuugacuaccugaaccugggagcagucuuaaaaccucuuuguaauaaggccuuguguaccuuuguguucaguaccucucuagaauuugucuauuccucuuuauuuguguugcuuugccuuuuucagacacacaaacauagcucaucaccucacuucuuagaacuguuuagaagcaguaaauuggaaagcaagaacaucacaaaaacagucacaggcugacugcaggaaaccacagaaaauggcugauuucaagagagacauuuaaguauauacugugauuucuauaaaacaggcaagagagccagagaacaggaugaaaagcuuuaugacaaaguaauaaacagcuuuuuauauugagacucacuaauaauaauuuauauuccuaaugauaccuaagugaucaagaaaaagguaauuuccuuaaugcugacauaauagcauuuuaguaaaaaagccaaacacuuuaucuugguuccucagaggcauagagacauauuaagggguuguguagcuucuuggguguccucuugagggauuuuguuuacauggggcuaagauugagguaucuacagguguguuauguaaguagcagauauaaauugauuccuuuucuguugaaguagacagugcccucaaguggaauuaaagagcacauuacaaaaggaagcaggaagaggagccgcuccugcugccgcugcugccuccagccucaccaagugugcaggugcuucagguggcagugguuuggaggagugccugccuuauccugucuugggugaccagagucucucauuugggcuugcaaaaggacagacuugugaaaaugaugggauacuucuaagagauauguuacucuuguguguggaacauagcaauguugcuuuauuauugagucaaauaauaccauuucugcuuuaguucuaagaguauuugauuuaaauugcaagaauuaaauggauacauaugauagcuuuauuaauuacuaccuuuagccacagggauggagauggauaccucugucucaaagaaggauaaaacaaccacauucuugugacagagauacauggaacuauucuuuucagaaagauaauuaauaaugaagcccuuaauuugaaaggauauaauuguguuuuuaaaaauuuguucucuagcagugagcuccuaugucauggauucugaacuggcuuauaauaucuggcauggauuccuuuuagcagagcaggccucaaauccgauagagcaugguugcuugaucccauugcagcccugccacuaguggcuccuggugaguuaguauuguacuucacaggguucaaauauguauguaauauguuuugguuacucuugccucaccuuauuuuccuuccacuccaucauacucccucccuacagguccccuuaccacauucaugucuuuuuucuuuuaugacccauuaagcuuaaugaaggccaccuguugagccuaguuggucucagugguggauacauaucuaaagacgaugauuuucucuuccccaggaucaccuaguagccaauaguuuagcaaggauguacccacgagccccuaccuaauccaugacuaguuauugacauguccagucuuacaugggcccaauaagcaaucacagcugcugugaguucaugauugcaguggcuguguuauggccagaagauaguguuuugcucuuauuuucccuaucuuccagguuuuauauucuccacccgagacuccaccccauucugcaacauugccugaaccuuagagggaguaguauaaguguucugcuuagagccgagcacucaagcuguuccccuuuucucagaaccuuggacacugcuguucauuguggggaaaaaaaaggccucucugauuaagacugauaauguggcuauaaccagagauguuuagaaggcaguuggacaccaugccaauuuagguaaacaacaguauuaaguuaaacccuaagccgugaguuucugaacuuguuuauaauaccuggcauugauuccuucuagccagagcaggccucaaauccaauagaguguggcugguugaucccaucacagucuugcuacuaguaggcauguuggguuaacuugcuugcuggguuacuguuguaguucugggguucacagcuggguaagacggcugauguccuacucuccccaguguacauagcaucuuucaacacugaaagcuaguuagcaggggggaaguaucugucucagcucuagcuugguuucucuauaucuuacagcuaaggaguauguugucuucagcaauagaaucucaccaucuaguucugauggcaaccaagaggauuggcaacaaucuguauugucuugggggccuuuaggaccugccugccugacaaggaggguaucccauaccugccacugggaauuuuguuuuaacaaccauggcuucugggaucagcagucuagcuaagcaggaaucuuccuucuaacucuaauuuucuuucaacuuuauauuuuuaaauuggcuuacaaaauaguggauuuuagacugucaggauggcuuaguagguaaagguauuugcugucaagccugacgaccugagcucgaucccuuagagcugacaugguagauggagagaaccaguuccuacauguugaccuuguaccuuucaugugcacugugguauucauguguaggauacuuugccaaacaaaggauaacuuugccuuguuccugauuuuaggagaauugcuuuagguuuuucuuuagcaugauguuggcuauagaccugucauauacagcauuugaaauuauauaguuuaaagucaucaauuagaguaggcuuuaaaaugaggcuacagaauuguguaauuauuuuuguaacaguuuuaaaugaaaaauugaagcuggaaaguaaucacuuguauauucuuuuuuaauacauaguuaaaacugugacacaaacuccacaauuuauugauauaaaaaucucuaauucaguauuauuauccuauagucauaugucauuauuacauaguccaaauuucgaggcuauaaaccauuuucaaauauuauuuauauacuuagguuauaauauucauguuuauuaauuguaagaaguuaaauaguaguuauaauuaauauaguuaacaucucccugucuaagcacaaaauauacaagauuaugguaaugaaagugaggaggccuaaagagauggguuagcaauuaagaguauauacugcucuuccagaguaccugaauucaguacucaugguagguagcucacaacuaccuaucaauucagcuccagaggauccaaccauccuuucuuauggcuuccuggaauaccuauacacacguggcauauaaucacacagauacagaauauacacauguaaauaaaauguauaaaaauaaaauugagucagauaaaacauaaaugaauuguagaugaagcuuccgaauguaauauugucauauuuuuauugauaaaagauguucaguacuauaauauguaacuuucuacuuaaguuacaugcuuagaaauaauagccuuuuuaauuaauaagauuaugcauguuuucucaaaacacuaugucuuaugcguucaaguaagacagaaaugcuacuuuauaguuuaaaaacaucucaacugggcaguaguggcccacacuuuuaaucucauuacucaggaggcagaggcagguggaucucuguguucaaggcuagccugguuuacagagcaaguucuaggacaguaagggcuauacagaaaaacccagucuuaaaaaacuaagaccaaagcaaccaaccaaacaaaaaacugaaaggaaaaaaaaaucucagagauugugauuuuauaauuuugaaauagucauuauuguuaaugucugcaaaugcuuugcuacuggcuuucuuaaaauccaguuauaguagacacagucacaugcuuuuagcucuuugagauauguauauguguguguguguguguguguguguguguauguguauaaaugugauuuaaaaaaucuuaagcuuuaauuuaagguuguauugaauggagucuaaaguuugcuuugcuuguuugccaggcacuuugaauugcugucuuuuuacaacauggaugccagguugcuaaaaucuugcuuugggacuuacagcgaguucauuuuuuuggauuuuaugacagauuuacuaguggcuccuuuuugccagucaauguucugaaaguuacugucacaaugaguucaggccuguggagccaagagaaaguuacuucacccuacugggaagaacggauuuuuuaucugcuucuucaagaaugcaguguaacagacaaacaaacucagaagcugcugaaaguacccaaagggaguauaggacaguacauccaagaccguucuguggggcauucaagaguuccuuccacaaaaggcaagaaaaaucagauuggauuaaaaaucuuggagcaaccgcaugcaguucuguuuguugaugaaaaggauguuguagaaauaaaugaaaaauucacagaguuacuguuggcaauuaccaacugugaggagaggcucagccuauuuagaaacagacuccgacuaaguaaaggccuccagguagacgugggcaguccugugaaaguacagcugcgaucuggggaagagaaauuuccaggaguuguacgcuucagaggaccuuuauuagcggagaggacggugucggggauuuucuuuggaguagaauuauugguaaguuugaaaagacauuuuaguguuuuugugaguguguguguguugugugagcacauacauauuucccccuuuuguaugcaguauauuuuuuauacucaugauccuuaggaucaaugguuuuuguuuguuuuugguguacuucucaggauagaccccaggacccucuaccacugaucuauaucucagccccaagguuuauuuaauaauaaacugagaggauauaaagucagugcuugaauuuuuaauuuuaacuuaaaauacuaauuuuaacuuaaaaauugucucuuaugauaggaauauauaagucauuauucuggauuuccauaucuaagaaguuuuaaauuaccuuauauuaaaaguuaacucuggggcuggagagauggcucagccguuaaagacuaggcucacaaccaaaaaguuaacucugccaauucuaauuaaauacuucaaaaauugugaaauaucuugugaugucugucauuuacaggguucucaguuccuuguguaugcuauuaaguauaacaguuuuaaggcaagaguuuugaaauauauuguagcaauuucaguuuuauuauacuucuuccugacuuuuauaaacugccuuggaauuuauuucuguuggaaacauaccaaaaauuuuuuuugaguauuuccaaacugaguauugguucucaucagugccacacucugacauucuugugaguagaagguuuuauuugcuucuugauugguuuuucagcagugagauaguuagguuuugacagccagguauggcuuauacuagcaggguugccaugcuacguaaccagccuauacccagcucuuugaaucugucuccccucugugaagugcuuauagcacaugacuuggggugugucuagggcacacucauacaguggauggcacacagcucuuuuucaguaaauggagcaaaugcugcuuuuugcuuaagguagaacgacaaaaauuaugguagaagucuacuguaaauuucagucuaacucuuucacaaaagaauuaugauuugaaacgaugagguaauuucacugucagauacagcuuuauuuguuaaauguccuaaacccaacugcaacuguuagucaugguauuucuuauuauguguauaauuuagaguuuucccaaaguaauuauccuguaaccacuuuaauggauaaucuuucuauauauuuuucuauaucucuuuaggaagaaggucguggucaagguuucacggaugggguauaucaagggaagcagcuuuuccagugugaugaggacuguggcguguuuguugcauuggacaaacuagaacuuauagaagaugaugacaauggauuggaaagugauuuugcaggcccaggagauacaaugcagguugaaccucccccuuuggaaauaaacuccagaguuucuuugaagguuggagaaaguacagaaucuggaacaguaauauucugugauguuuuaccaggaaaagagagucuaggauauuuuguugguguggacaugguaagaaaauuuuggauuguauuauugugaauauauguauuaguuucauugccaauuuagguuuaaauugaauauuuaaaaugaauuaagguacagcacuuuaaagaagacaguucaguuuaucuuugguccaggaacauugaaauaggacauaugagcagacacagaaugcaugugcuacauccuuuuccaguuuuaauaaauugggagaauguccucagucuuuaaauuuuccuuauuauaauugaccaguagacaaaaacaaaaaucaaaccaaagcaaacuaauaaaaggaacugacaguuuccugaccaagcccaaauguaugacacuguauuuuccuuuaauuuaaaaagauuuuuuguacaugcuuuguauauauuuaauaaaguuuuauugaucuuucugauaauaaugaaaguaaaaagucauuaauaaaaaguaccuagggaaaaaacugcacugcauuugaguagauggaguauucccauaugauuuguacuguuuaaaacuguuuucuuauuguggucagauauggcuaauagaagaauguguccaacuuaaguauaguuagagaacaguucaguggcauuugguauguucucauuaugccuuuuccauggucugucugcuggacuuuucuaucaucucacggggaacucuguucuuauuaaauacauucuggccagguuguccaugccuguuagcuacacucuuaguaccagucugcaggcaccucagugaggucauacacucaccuuuucuguucgagucacucauuuuuauuacugaauagucauacuuguuaauaauggauacauuccagccacauacugaauuaacuuguggcacuaagagagugagaagaaagagguugagaacguuuuuauuauagauugaaaauaugggcaaaaguucauuauggauagagauuucuuuauaauaucaacuccaggauguauuaggagagguuaugaacagugggcucauacaguggacuaguuuuaguaaucauuuuuauuuauucagaaauacuguaaagaaaugaaagucaggcaugguggcacacaccuuuaaucccagcacucgggaggcagaggcagguggauuucugaguucgaggccagccuggucuacaaagugaguuccaggacagccagggcuacacagagaaacccugucucgaaaaagcaaaaacaaaaacaaacaaacaaacaaacaaaaaagaaaugguagggcacaaauguuucuagcauguucuuguuacuuuguacuuagaaauuguguuggaugcucaccaguuagguauaaaauaaaaacuugcuagacucuuacuaugugagauuagagccagagugagaccuguggguuucucagaauugcuaauaauuaaaaccaguauucuuuaaaugugaguuuaguguuucagaggagaaauugugggcugggcagagagaagguugcagaaagcaggccaauaaucuuuggacucagucuccauauagauucuuuggcccagguuuucauugugacaggagcuguuuggauccucuccucccucgaugguagccuaggggaucaucuuguuuagcucacgcaggcugucuuaaggcuugccugccagguccacccauguuuuguccaucaccauuugacuuaugcaagagucacuuccaaacacugucauuaggcuuauugagaaguucuucaacugcaacuuuucucaugccuuuuuguuuccagggacacuuuacacaugcacuucugcucagagcaguuguuucacuggcucaucuguccguaccucuucaacaacccacguggcuggugucacaguagaauauaacuuagaaaaaucuccauuuuggggaaagucuuguauaccuacaaaugacaaaagaauucugagggcuggagagauggcucagcgguuaggagcacuggcugcacuugcagggguccugaguuccagagcaucuaugugguggcuuccagccaccuauaaaggaucuagugcccuuuucuagcauuuagguguauauguagcagagcacucauccauguaaagaauucuggaguaacuuaccauucugcuauagaaagucauacaguaauucagaugagcaaaguguccaaggauauaaaugugugauuaacuuuuaaggguagguuucugaguuaaauaaugcauuccuagugaauuuucauaugcaaacaaugucacuuuaaaccucaggugguguuauuaauacagauuaaaguaugaaaaauacuuuaaacuauuuuucuguguguuuucuauaacauuauuauuguuguuguuauuauaaaaccuaguuacuuuagcagcuauuucuaauauaaccuuucuuuugggcaaaguaguuaaagguucucaauguaaaauaauuuagaagauucuucuguaagaaauggagauguucauauuuacauuuaauugaggagggcuuaaaggcuuccuuuguaugucauuucuaggauaacccuauuggcaacugggauggaagguuugauggaguacagcucuguaguuuugcaaguguugaaaguacaauucuccugcacaucaaugacaucaucccagguaugucuccuuuauguauucagaagacaguuucuaacguguguuuuguuaugagaauggaaauauauucuuuaagauaggucuuuugaaauuggguuuuauaaggcagaauugucaauaaauagaauauccuuuauuuaccucaaacaaaagcaauaaagguuauuucuaaaaguaguauuucuaaaaguacugagugaaguuuauaaauuaucuguuacauuguugucuccuaggcauucuaauagagaaaaaaaaccccuuucuuauaauuggaagguucaaaaauacaaaaacugcugccuguuggagcaagaguugaaaguaggauccuguaaagagaaauugguuaccucaucuacacuccacaguagauucaggauucuuguuaaaugauggcugaaguucuuuuuguuuuaagauggcauuaugauggaucaugcuccaugacaguggucagaaacauuacauaauuuuauuauauauuauuauuauauauaucauuauagaaguaauaaucaggacgaacaagauaucucaguggguaaaggcaguuaacauuuauuucuggggauggaacccagagucuuacacgugugguacagguggaaacgcagucaaagucuuuaccucugagauaaagcacagccugugaaguuaacaccaaaugagaaagccaccaccaccaccaccaccaccaccaccaccaccaccaccaccaaaaaccucugcaaagcuucagaaucuuuaauuuuguuucaaguaagugucucccuuggcugcuaugagauaauuggcagugguagcaacaccagccccggcuguuagaauucccagugguaggcuaguucaguagagccaagagaggcaggcauucagagauggggacaauagugaauguuuuguaacuaugaauagcaggaaugugcuaggccuggaacuagaugguuuauaugcuuucuuuauguucuaaaccaauuuauaaaauaggucuugauaaauuuuuugcugauuuaaaauguaaaacagaacaaacagcaaaaguaacaaagcaaaacuguggcucaaaucagacuuggauugucugugaugaagugauguaaguggcagagcccaaguuucuguccaucccugucugucaugagcgcucuucagucuuccagcaaaccccuuaugcucagaguguucuugcauuaugaagaaaugcauaaaaagacauauuucuuaguguuacaugcuaggggauauuguuucuauggagauguauuuugucucugguucuauaaaagauaguuuuacuguagcaagaaucauaagugagcagcaaacuauuuuuuuucugcccaguguuuuuccauuauugguaauguuaacauaaaauguuuuugaguuuuuuucuauagcuuauuuucagucccgaauuucuuguuucagagaaaugggaaaugaaggcuccugggcugcacucuguccuuccugacucccuguuggugucaaggcauaaauacuuauuuuacaguuugaacauauuucccacauagcuuuuaguuuuguagcaagaggugugaaauucguguaacagcuuuauuucaauuuugcuauuaaaaaaaucugucauacuuuacuuuugauuucuuucgagauauauuuguuauuaauucuuugagaaauuucauauauauaauauauuuugauuauaacaccccccaucuaacuccucuugggucccccauucccaauuccuugcucaaccuuuuggaaacaaaugguguauauuuaggggaaagcauguauguguguucauauuuuauuuagugguauuuacuuugucaugcuuguuuuauagacaguauaguuuaggaaguuugugaguugaaauacuuuuuaauguuauagugagugcuuauuguuuuaaaaacagcaauauaaaauaccauucagauaguagcaagcccuuacauaggcuuuguuagauaugaauauuguaggaggcaaagcagguaagaauuauuggggcuggaguguagcucugauagaacacuugccuaacaugaguaaaucuguaaguucaagucccaguacugaagagacguaauuauuagggucaguaagauggcucagugggucagggcacuugccuucaagccaaccuaauuccuggaacucacaucguaaauguagagagcgacuucugcagauuguccucugaccucugaacacauauaugcaggaaugcacacacaugcaugcacucaggcauauacacauauuaaacaaauuuuaaaaauaauucuuauuccaaguuuucauuuuaaugaauggagauagacaaucugugaguauaucuaugaucaguuagaugguaccaggcuagagaaugauaaaacaagggguaggagauauggaguguggccugucacuuucauguauuccuguagaucucuccaugagacauuuaagcagacacagaagaaauaauugggccuccaauuuuaguagagcugaauugagaggcccugucuaaauacauuuggagagcuaugcugauuuuauaaugcuaacuugcuugauagcugagaaguccuugucauuuuuucuuucauuauuugugaauuuuuacaggggaacaaauucuagguauuacuucuuuuguacagucauauccucuagugaaauuucacuucaguuagcaaaaagauauguuuugggcauuuucuuuuuuaaggaauuuucccccuaggggggccauccaaugguguuuuugaaaccuuaaaacccaugacauuuuuugagugaauguaacugucauuuuuagcuaucuuaauugcauugcuuuugaguuuuguauuuuauagcugaaugaaauauguuauauaaaguugugggauuggggaaacaauuauguugguauuaccauuaaagaaggaagaagaucccugagcauaaagcucacauaugcagacguggcuguguuauuuucauucuccuguagaagaaaaagauuugaaauguuccacccucccccaacgcuucagcugcauuucuuuauuuaaacauauauauuauaugauuuguaugugaauaacauacauguauacauuucaccucuaaauuugcuugaaauguaaauugucuuagauucugcaguugcacauaagaaauggaaaggagaguagaaaaaaaaacauuuuuauuuucucuauguaggaauugggguuuauccuuacaaguaaaauuuauuuuuccuuuuuuauaguacuuauauuaaaaacauuuaaauuauauuuuauuuaaauacuaauauagaauuaaaguagcaaaaccaucaacaacaagagaaaaccacguacguuucaugauguaagagucccaugacagggaucuugaagauccuugcuuguuauuaacaucauugcugguuuagagcagucaugagaaaggaaaagaaugcuuuuucucuuucaaaacuauugauauucauaaaucuugaauagaagauaauuaagaaugauacugcuuuuauacacauaaauuauacuuauuugccaacaaaauaaagcuugcaaauagacuuuuaaaagguaaaguuguuuagaugaaaauuaauuuaauuugaauaagccuucaucuauaucuuuuguaucauuaacacuguuuucuugagggguaaaaagcaugaagagucucucuuuaguuccuuaguuuauuuauuuauuuucuugcucaauuaccucuauuugugggacagaauuaacauuuccagcacguaggaaagauuccuuuucagcagcugaauagauggugagauuuggaaagaauucuucccagugaacuguuucuuacuguuggugucucaauaccuuugcuucagccugcuauaaaaaugucccucuuugcccugcuguuucugauggcccaaagcauuaauuaacacaucugauaugauaccacauccagguuugugaaguggugaugacaucuuuuugugacacuccuaaaguaauacauuucugcuuguugagcucugucuccgucuuuuaguuguggagguuaagaguuuaauauaauuaaacaacucagacugcacaguuuaugcauagucacagaaauuuaaaaaggaaguuguuuagugggaaccuuuucuucugaggcugaucccaagcucaugauuucuuuuucauccuugugugugugugugugugugugugugugugugugugugugugguguugcaugucuucauaguucauguccuuuaaaaagcuaacaguuuuguugagcuacaaugcauguguaaccauagaacacuccauuucaccucucaucugggaagcuucuuagugcacuagaugaccacugacagagacccucaacuggucaggguacaaagaacaagagacaauggagcacucagccuuaagugggaacauacauccuguaccucccccaccaagacucagggaacuuuacagaggagagggcaggaagguuuuaagaaccagcaguagagguugacuucaagaaaacagaauuuucuggauacagcagggcaguuguauauauaaucucacaugaauugugucaacaugaacaagacccaugcagccucaagccagacaaaaucccagcauggaaggaggggauaguaggucugaaaucccaccacuagcugaaacacugaagcacuugguagcugcugggagagggaacaucugcaaacagcagucuguucuuuguuucuuuaaguugccauuucagaaaaguucuauguuagugaauuuguauaggacaugguuugggggauuucugauugacuuuuuauccaccauaauucucugaaaauguaaccaugcuguauaaguuuucuuuuccuuuuaauugcuaacauaguccuuguuuuugguguacuguucauuuaacgagugcccauugaaguacauuuaaguugggaucauaaugagcaaugcuuuaaugagcauuguaugagauuugaaaaaucuuaauuuuucuggcagaauauauguagaaauauguagaaaauguauauuuucuuuguguaguuuuagaucauguuauuuccauaguaaguuuuaaaaauguuuuuauuaguauuaauuauacauaguaauauuauaauaauacauuauaauauuuucauacaugugcaucauuuauuucaaccaugauuacccaguuaccuucuugaccccucucagcuccacuaaucguucuuuuccccauuaguuccacuuuaaugccucuguguguguguguguguguguguguguguguguguguguguguguguguguguguauguauguauguguguuagacuuaaugaguuucauuaggguugcuauagaagcauguauaauuuaccugacugguuaaaaaaaaacucuugcccuuuccuauaaaccauuaacaauguauaaauccuuagggagggagggaccccaugagucccuucccuuuccaugacaagcccaaucacauguacaucuuguuuaugguauuauagcugcuguaaguucaagagugcagcaaccuggaagcuagcacuccacaugcuucucugcuucuuccaucucuuauagaccuuccacccuugaaugcaguguuuccugagccuuggaaaggaugauauaguuguaacaauugcaguuggacauugaacaacuguuucuucucagcauuuugaccacugcaguaggaagcuucucugaccaaaaugacagacacccugugggcauaaacauaaguuauuuagaaggccacucuuguacuagugagcgcaucuggccggucauuguuguuguacacagggcaaauagcugacuaugacuugauaguucccccuagcagccugcauuacauuuucugcacuauaagggauagauagcacagaggaaggucccagccugagcacagcauaugauaucuucagcucaccaucuagaucugguaggcaacuaacagcaacaauuguuuuugcuguuuuagggacuuccaagaacauucuugaccagcaacucaaagggaaguagcucacacccuuagcacugggaggaccucaucuacccacacagaggaccacuauucuuuacaauaagcuuuuguaaaaacacugcuacacugucuuauagagugacuucuguauggugucacaugaccauuggaauuauguaaaugaucaagacuuucuacaucccccucaacauggcugcuuuucguguuagcuguucugagaaauguauggugauaguucauugcaguuuuguuuccuuaauagcucaggauacugaacaucuuuucauguuuuuauguccuauacuuauauucuucaguaaaauacauuuuuauuuguuuuggccaggcucuaauugaauuauuugcuuuuuuauuguugauuuauauaauuaaaaaaauguauucuagacaccaguccuuuguugaauaugauuuacaaguauuuucuccuagucuugucuucucauccucuucacaagguucguuuuuugggauuaaguccaacaaauuuuacuuaguucuguauuuggaaguuuuucuuaguuuuaaaacaugaaauguaauucauguaccacuacauuacucuacuaaaauauaauccaucaauauuaaguguauuuagaaugucauacaucuauugcuguuguguagcuccaggacuuuuuaucaucccagaaugaaacccuguuacucacucccaauagcagcuucucuccagaccuuggcaacuguguagcugcuuucuguuucuccaaguuugccuauucuguaauuucuucuauauaggggggacuuuuggccaugagagacaguuagagcccaaggaugguuugaagaaccagagcucagaaggcaauucugauguuaccuguaagguuccuuacagauacaguuauuauauacaguuaucuaaaauauuuugauuagucaucuaaacuuacagagauuuuuuuagauaauugcuguacauagcaugccugcacaugaggcuuuuauaauacccucauucauuuuuguuacauguuaaauccucauuuggguuugaauuguguaccaugauagaggauguugaacaauacaucauuuaaacaaccccucuuaauuuagugggcuauucaaauuuauagaccuucuguuugaguaauuuguucacucuuuuauuguuaggauuuuugcccaagaaucuccaaaaauacucuuuuuuuuuccuuacagaccaaaaagaguaaugauuaaauuccuaguuuuaucacuuugaaugcaguccugcuguguguauacuguguauacuugaggucuaguuucguuugcucagcaguguucuuguguguagcggugguuugcuccauuuuauuguuauguaguaguaagguguauuaguagaccacauuuuuagugaacucuaucuguuguuuucuuguggugcaggguugaacccagggcuuuggguauguuggcaagugaucuaccacagaccuuuaucuucaguucacaauuuuauauaccucaauguuuauuuguucuauagaauagauugguuuuagccauuaguuauuaugaauagggcuacugugugcauuuuggugugcuuuugaguggacuuauauccuugaauaucuuuaaucaugauaauuucaaucuuaagaaaauugucugcuaaauuuauuccucacccugucaaccauaucauauuuaaguuuucuucagauuuaagccauuaagccuaauauguauauauauguuggauuacaaacaucucuuuuuaauagaguuacauacuuuuaguuauaguugacagugggcauaguugucuuuagucaguuuauaugcuaugacuugggcauuucuccagugacaaagaguuauuuuuuccuauaaaaacucucauagaugauauuuacagauaccugaaugguaaugucauaaaggcacuuuuaguauuucuuuuauuauauuauuuguuaaaauuauggucauccaguauaauuuuuuaauugaaaugauauuccaguauuucauuugauuguauuuugagauguuuaagauauauauaauuuaauauauauuuaauaauauauuucccucuuccuccaaccauggaaaaagauaucaagcauuauuuauauuuacuuaauucagugugacucccuuuuucauuuuaaauguccuuuucuguauuuuaaauauaaaaaaauuuccuauuuuuccuuucuguccucaaaauuccacugugggugaucccguuuuuugcugauaacagcuuuaucagguauggcuccucagcauugugcugcacuucauggaugugcuguuggacuuccuaagggggaaccuuucaccuaacucccuuauguuuauuugguccguguuuauaagugucauaugaauucugacauuguuuuaagguuuagaaauaccuuugcaucuaaagaaguuugccaaaccuuuuugugucuguacuuuggaaugaaacuuagguugcuuucuuaaaaaaaaaaaaaaaaaauuacuauugugcgucucuggcuuucugcauuauugaucugugcauaaaucuguguuuuucuuguuuucauguguuuguauacacaucuguuauuuuuaauguguuuguguuaaaaguggaagcauauuuacuccucagagcauuccuaauccugaucugucuccuaaacagacuguuaucaagcuaucucugugaaauaaauuaaucugagauucucacuagaauggcacaaaagguuuuaucaaauacauuuagugccacaucauuuagagauucuuuaggcaugucggcguguaaagauucugauuuuugcaguaaauaaaugguccaucuuuaucucagcaccuuuuguaaaugcuugaguguaaaacacuguaauauggaggguugugcugggcuugcugaucuggaaaaugcagcaaaaacuaugaauaagguuuucuuuauguaagguuuucuuuauguaaaguuuucuuuauagcuuuuuuaaaaaucaaacagaaucgacuuccucugacuagcuuuucaaaaguuaaagcauuuggaaggauuuacaaaagaacagugcugauguucuuuuccgugagaaauuacuuugcaguguuuuugagucuuuaaagagaaucugcaugacuauaaagauuauucuuuuuuguuggaaaggauuguuuuguuuuguuuaugcucuugucauugauugcuaaacuauuucucuucuacaugaauuuauguuuauauuaaaaaguguguuugcuguuucagauagcgugacacaggaaaggaggccucccaaacuugccuuuaugucaagagguguaggugacaaagguucaucuagucauaauaaaccaaagguuacagguauggagcuauucuugauaguuuacaugauaucugauuuuccaaauguuaaauaaucuauauaguauuuguguguguguuguguguguguaacucaagcauuuuauguaaacuaaaguuuuauguacaugauugugagggugcaguaaagaaacuaaauggccaccccaugaauugucaggggagguuuuugcagcugaaagaguccagagcagaaagaaaaggaagcagacuggacaugaucagggccauuugcaagagaagcaagaauugugggggcaagggaaacucuugccuuuauauagggaacaaauggguggcugggaguagggaagcccaugagcuggagagaguuaggguagaggaggaggugagaggagcaugggcugugaaguguuucacagauacuuaggaugccgagggagccuggaggccagcaugcacucuggugugcuaauagacacuacagagaaccauuugucccuucuaccagugauuauggaaauggcuccuuugguagagaggaaccagcuucagaaguuccugaggaaugcuggcuuuuaucuaacuagcagaaauccuucuauagccuaggacagccuuuuggaguuugaggaauuauugucuccuuuugacagaacacuggggacauggagacaaggagauuccugagauuucuuagcuaucacuaucagcugccugccuauuuuaauuggcaacucucaggucaguggaggcauucuuuaaagaaaacaaaacacaauaagcucuugaggacuagcacacacaugcacacauaccuuuucauacacauaccuacaugucauacacacagaaaacacuccauaagaucaccuacucucaaacauaaaaaagcuauagguuucuuauuuggggaugagggccuugguaaguuuccuauguugaauuuaagcuucuggacucuggugauuccucuauccuagcuuuccaaguagcuggcuacagguguacugcaugaaguaugaguuaaacugugaagugcagagcuuuuuacuuuaaauugaaaagcaguuggcuucaguauagguugaggaauucgcacugaucaccaaugaggugugucuuuguauaucuaagacugaggcagggaagugucuuguaccuguuuguaaugcaggucuacuuucuucugauuuaaccaucacccuauaaaccagugguccucaaacuuccuaauacuaauacugugacacuuuaauacaguuccuuguguuauggagacccuaaaccauaaaauugcuuuguugcuacuuucaaacuguaauuuugcuauuguuaagaauuguaaugaauaucuaguauguaaucucccaaguugaaugaccacagguugagaaccauugcuauaaaccuaugagauauguggaagcuaauagaaaaagaguugugugaucucuacauguaacagaggaagauucugguagagaaauaaaauuuuacuuagcaguuuagaauuuaacuugcauuaaauagaguuuuuaagaccacauaauuaaucucuaguaugauuuguccuauaaucuaaagugugagaaauuauggugcuucauuuuuuucagacaugagaaaauuacgaaauuuuauuuauucauuuauauguuuauuacuaugaauggcaaguuuacuuuuuuucuuuaaaauugaaacucugggaauucagaauuaacauccuugccugugagcuucuuauccacagcagacaauguuguggcccuguguugcacauuguucugcuguucuuugucucaguggcccuuucugagccagcugcucauccagcuuuacacuaucuucuuacccauagucucaugugugaagaucaagcccucaaggauggcauagugcacugucaucagguugcagccucugggugccuucacuguguuuuuguacaguuuuuccuuguuggcuugggcagaguccucccccagcaaugcagacuacuugcuucccacugaaccuuuucuccauuucacaaaguagcuggacuuggauuuucuggaaggauuucagcugaggaacugguaaaaaaaaaaauuaauauagcuuuuggaccuccaacuucaauuuccuuggucauguugaguuccugcugcuaugucuugagaucugaguucaucuccagcuggagcagugccugagagauggaagauucaaacucacugggcuucuaccauugggcuucacagucuuggcauucaagcuuaacauggccuccaccugaggggaggaaggugccaccagucacucgggucacgggcaucacugcuaggaccaucuacuggcugccccagagguccuccaaaaguccuuccccugaaacuauaaaaaacaagaaauuuuacugguaaaauucuaagauguuuaaauaguaaauguaaaaaaaaauuaaguuauuauuuuuuguaauguuuguagucaaagucaacagagccuuauauguggugaggaaaguccuucaucacucaggcauagcuccagacacugaaguuauguuccuuuuguuuuguuuuauuuuguuuugauuuucuuuugggggaaaggugauccugggaucaagcuuagcaccuuacacaaacuaaaccaggacucuacuaccacacaccucgccuaaaccugaauuguuuuguuuuguuuuguuuuuuucaagacaggguuucucuguauagcccuggcuccuggaacucacucuguagaccaggcuggacuugaacucagaaauccgccugccucugccuccccagugcugggauuaaaggugugugccaccaugcccagcuaaauuuuuuuauucuuaauuucaguuugauuauagcauuugaagauuacaaagggaaauuauaaucacaugggaugcacucugagcaguacaucauuaggcaguuguguuuuucugugacucccagagaacgcacuuacacacaccuuuguaagagaacugugugcauauguaggcucuguaacacugcugcacauuuguucuuuuguagacugaaaugucuuuauaucacagcaguucucaccccauggguucugaucccuuugggggucaaauguccuuucacaggaauugccuuagaccauuagagagcacagacauuagauucauaacagcgaaaguacaguuauaaaguaggaacaaaacuaacuuuaugguuggggggucccgguauuaggaagauugagagucacuguuauaugguaugacuguaacagguuaaaugugugagucaguaguuugaucaaaugaaaugagaggagguaauuuuaacauugagaaauagacuacauggaaugauuuuuuuuuucuugacaugagacuucucuguguaguucuggggguccuggaacuuggucuguagaccaggcuggucuugaacucagaucccucuuccucucucucccuaaugcuaauuaaaggugugugccacuacugccuauggaaugauuagaguuuuaauauaaaaguaagcaggcuuuagcuuguucccauuugcuuguauugaccaauuaccaaacuucuaaagcugaagacaacaauaaaguacauuguauaugucuguuaucuguacagcagcugguacacaauauucauauuauaaaaaucucuuuuacaccauuuugaccuuuuuuuaaaaaggaauuuuucuuuuuccacaggaucuaccucagacccuggaaguagaaacagaucugaauuauuuuauaccuuaaaugggucaucuguugacucacaacaauccaaguccaaaaauccaugguacauugaugaagguaaucuauaacuuuaguacucuuuauaaugauccucucuguuuaguguguaagggaaaauggccuuuucaucaauauuuguaauuuuuggaaccagugaguagaccauugcugacaugcuaauauugcuaaacugaaauauuaaauguaguuugaacugcucugcuuugaggguuacaauccauuugaaauguguuaguagucuguucuuaucucuuaacucaugugcuuaggaucaaaguuuucuagaaaugaaaugacucauuuaacgacuguccuauuuuacuuccuuuaaaacauaccaccuucccuucuuaagacaucauuuucuuuauuuccuucaucuguucagcaaguaguuauugagacagucacagguuacuaugacaaagauauagcccuaacccuguuugaaguuguaguccauuuauuauuauagaaauccaucagacacaaauaauuggaauugcaauguugaugggagcugugacaggacuuggugcugugaggcugcuagagaggucacagggcaacccauguuuaccaggugucucagugcugugauaaaacacuuaccaaaggcaacagggggaggaaaaggguuaucucaucuuauguuuucagggaauaguucauuacugagggaagucagggcaggaacucaaagcaggaaccuagagguaggaacugaagcagaggccaugaaagaacgcuacuuacuagcuuguuucuaaugacuuguucugucugcuuucuuauacaacucaggacuauguguucuaggguggcacugaccacaguggacugggccuuccaaaauucaccauucaucauuaaucaagaaaagacccuauagacuuaaccuacaggcaaucuaauggagucauuuguucaacagagguuccucuucccgaauaacacugcuuguaucaagcugacagaaaacugacuugggcacuagagaaaugauucagagggaguaauaucacaaguuaggucauggaaauaguauauauaaagcccucugagaagaauagagccuagaagacuagaaagauccagaggagaaaagggaacagucaaugggaccaggucacacauaaucuccuagcuauacuucucugaaagaaaguggagaaacacugaaaaaauuuuaguaaagagugguacauccaaguuugucuuuugcaaacagcauugugguacaggacagacaguagacucaaagugaauguaguaaguagacaccauugaagguuuuuacaguaacugauuauaauuucugagauuagauuugggggagagauagaaguaauuugauauaaagggauauugagaguuggauugaagggagcuauagcuagauugaauauaagaguugaagaagaaaggcauaucagugguaaccccuaguuuucuggaucauguacuuagauggcaggaaguagguggugaauuugauuuugaauaugauucauuugagggguccuuuaagcuucccagagguaaauucuuaaacaggcuugguuggaugucuagguuuaaagcuuggacgagagauaagagcuagagaaauacauuuguaaguugucuucacacagggggauuaaaguucuuugauuaacagugaggagaaggggcagugauugaaauguugaagaacuuaauagcugggauggaaggaagaugagucuuaauggagucuaaggaaaagugaccguggagcuuuggguaaaaccaagagcccauuggucaggagugcguugaguaagugaauucucagagagagcacaugaagugagacccacauaaagcucauuugaugcugacucuggaagucauugauaaccccagucaguucugucaugggaagaagucaucugaggcucaacugggaugugcuagcauguagaguguaguaacugacauagggcaagaugcuuggguuucuuugugagugugugugugugcacacacgugugcguacacaugcauguguaugugugucucugucuguuuuucugucuaugucugccccacuuucuacccuuuugugcauaugauuaauugucuggacuaguuccuccaguuuaauggucuggcugacugcuauuuaccucuuaaacugaagcuuuuguuuguucagaagccuuccuuguucuugccuacucucuuagguuagguuaaaugucccguggauacucgccugucuuuucuguaaguuccuagugcuucuguagugcuuuauauucaguagguuugguaaacuaaaugaaaaugugaauuuauaguguuguaagucucuaugaugacuacauuaugcaucacaugguuucaguuauaagcuaaaacacacaguaaaaaucugcaauuguauaacauagguuacauauguacuuguacagaaagugacuugaguggguauucuccacaucugauuccugcacuggguggaguuugugaguguaggcagcaugaccugccucccucaagaacuccccuuugccuacaaggcaggacgugugucuaaaugguguuccuuuaagagggccugucuccugguggguuacuuuuguuaggacuuggucuguacuacaaauucuuacuuuucuaacuucuggagaguaccugguaggaacuuuuggccucuacaaauacuacuggucucuggaugugcauggagaccaauuaggaugacugaggaagccugaucaugcccugucauucccagcaggucacaaaugcucuccaaggugcugauugauuucuaagaaaaaggagcuaauggaaauagaggcuuucauaaucuagacaaugcugauucuuccaauuuaugcuacauaaaucuuuucaucuuuucauuaauauacauuuuguacuguacuaguaucuuauuuacuuuacuguucuguuacuaugaaagagacacuaggaccaaggcaauucuuauaaaauauuuaauugggggcuugcuuaugguuuuagaggguuacuccaugaucgucauggugggaaacagucauggcacuggaacaguagcugagagcuuuacucuugaucuguaggcagcagagaaaaagagacugggccuggccuggccuuuugaaaccucaaaagcccaccccuagugauacaucuccuccaguaaggccauaccucuuaaucucucuaauccuucucaaacccaggacucuguggugacuaagcauuuaagcauaugaaccugugggggccauucucauucaaacucccacagcugguauauucauaacuucuugagcuacuugaaccugauguaguguucaauagcuuuaugaaauaauauuggucguaaaaaacuuagaugaaaacuggauauggugauacauaucuauaauuuuagaauuugggagauagaggcaggaggauccggaguucaaggauagcuuugacuacacacaaacuuggaggauagccuggguuagagguacccugcuucaaaaauuaaaaaaauuuaaaaauuacaucauuuucuuaucuuccaguucuuucauucuuuccauucccucuuccgcaguauuccucgagcuuuagagaaguuguauaaguauccuguuuaaggcaaacacucaauaauuguacauucugagucucuauauucaccccugcuuacucuauaaagagucucuuaauuaaggauaagaauaguguguaagacccauagguuuuaaaugacaucuuguguugguuuguguuuucacuuaaccuguuuauuagugugggcaaagaucuucucacugguuuauuaguucuucugugaauuaccuuuucagaucuuucauuuauuuuuuuuucuugauccuauugauauucuuaccuucugagaaaaguagauuugcaaguauucucuccuuuagcucaaggccacucacaguuacaaccucuuuucaugaacaaguucuuaguuuuaaccagaugauaguugucaucuccccuuacaggcuuauaugcuuauauguaauugcucucuuccuugaagucauaaagagcguucuucuauguuguauucuagacauguguaguuugccagacacauuguuuuauacgcuaccuggaacugauguuugcagaguaugaauaagauccugguuuauugguuuuuuucauuguuuuguuuuuguuuugucaugccaggaaccgaacuuagagccuuacacaugccuggauugcaagcuaccaugugggugcuaggaaccaaaaccagguucucugaaagagccauaagcauucuuaaaugcugagccaucuuucuagccccagauguuuaaacauauguauuauugauuagcucaacaacauuaaaauggucauucuuuccuucugagaagcagugugugccugucagcuacauuagucacuuaaggaagcaacuuuuggguauuguuuuuaaucuuuaaguuuguuuucuugaguuacuucuuugggguucacuuuggcuuaagcuucuuuauucuuuuuuuucucuuucauuaauguuuuguuuucuguuuguuuugucuuucugaaaaaccaagucuauaugaguuaauuaauacuuagcuuuuuuguuuuuucuaaacuaagcugucaauaauuuuuaauaaacacuauauaucuguguuucacauauauuuuuuauucuuugguuucuuuuuccucucucucuuuuuuuaacuuuauuagaauacugaguucauuucacacguguauuuuuaucuuccuaccauuucuacaucugacuaccacuaugacuauguccuauccuacuuaaaccaaguaaaggguggaguucuauucuugaaaacuaaacaggcacguuagacaacacauucuuggcaauugaaccuggacagcauuuaucaaacacaguaggcaaaguucucacuuuacauuguaaaaagaacagccagauaucaacuguuaaagaaaugaaguaagacugacuauuucaaaugguuuaaaccacuuucuuaaagagacauccaccacugccagagaccucgagucccccaggcagucuuccagaagcaguucuuccccaugauuaaugagcuuggcuuccauuuugggaagaaaccaccuuuuucauacuugcugcaauugugccuuaauguuuucuauggaacgagguucuuuugguguuuuaggaucuuuuucccuauuguuugaagaaccugacccuuugaucuuaguguuuaugguuuuacgucccuuccauuuuuguuugauuuuugugcuuuuuuugcugggggauauuguacagauuuauucacuaguauuuuucuucaguuucuugcucaucaaaaucaucauugucaucauccuaagcaucuuuaucaaguuuugcuuuuuuucuguggaaccuuguuacaucucuagggucagauugcuuucuagacauauuuaagaguuuuauauccuccucauccucauguuugucuucugacuguauauuccucuacagcuacuaggugcuguucacuauugugcacaggcucugauacuucagcauuaagaccacaaguggugaaauuucaaagucccuaauggaaacuauugguuguacagacauuuucacaauugucaguguuacugaaacugccuucauguuaguucauugcuucugcccuuacaaaggcuuauaauucagcuuuugccccuguuucuaaacugaccauucuuaauaauaacugguacuuauuuucaucauuauccacuuuaaaaugaugaucuuugucagccuuuaguucacaacugaaagguaguucugaggccuaagggggcucauguccauguccaucgagucuucaauagauggaagacagaagaaacugugacacacaggacagaaucacagcagggcuuuuauuuuauuuuaucuuuaaaacuuaacuuauuuuuucuuugauccaugaguuauuuagaguugcuacuuaauuuuucuuuauauuuguucacacagauuucuagcuuagagaguauuaaccuaugugguacugaccagacauagaugaacaacuggugccaggugacugagacagaaaaguuuggagaugaagaagagaaacaaggacagacguuauuuagucaguagguuuguaguacugugagcauacuugcaaagggaucaugugcucaguuagacuagaucuuuuuauuguuuuuagagauacaagcauauuuaauguucuugaacaacuuuuucuaauuaagaacaauuuuucauaguugcagaagacccugcaaagucacuuacagagaugucuucggacuucggacauucaucuccuccaccgcagccuccuuccaugaacuccuugucuagcgagaacagauuccacuccuuacccuucagccugacaaagaugcccaauacuaauggcagcauggcucauaguccacucucucugucagugcagucugugaugggggagcugaacagcacaccuguccaggagaguccacccuugcccaucucuucugggaaugcacacgggcuagaggugggcucacuggcugaaguaaaagagaaccccccguucuaugggguuauccguuggauuggccagccaccagggcucagugacgugcuagcuggacuggaacugguaauuuaauuuggccaaaaaucuacaacucuuuuccugcaugagguuuugucuagauuucccccuauuagauaauuuccuagaaaaucaucauguguguguguguguguaugugugcgugcauguauguguauuuccaguaauagagaaaauauucuuacuguauggccuagcuucauucacccuuugccauuccuuaaacuucuggcucauuuuuuccucguguuucuuugucuguaaucaaggaguagaggaauuuuuaggcuagacuauuuagcuuccuuauauuaaguauaaugcaccuaacaaagcaauuaucaguuuuucuucuuacuccucagccuccucugauaugauuggcuuuacaauuaaucaucauguucagaggucuuugguagaagagguuuucccuuuggauauuagaaaagaauauagugugauauuucauaauuaugaaugaggaacuugaauaaacuuagcuuuuaccuuaaugugcuuuuugauuaauuuuuuucauuuguuaucuugauggugaggaacuagauaaauuaaucuaccuucccccgccccuugaucuuaauacuuuugaaauggcucagggcaaaucaguaagccaaggaaaugcaugaaguacuuccuggugggcuaaagaauugucuucuuaaaccacuaccucgucagcuagucagucccuuuucuugaugcucuucuauucagcacagauuugaugaaggaauucagacaaaguguuaaguucuuccccacuccuucugcaaggugcaguguaacacauaccgaagaagacuuucuuuuucaggaagaugaaugcgcaggcuguacagauggaacuuucaggggcacgcgguauuucacgugugcccugaagaaggcacuguuugugaaacugaagagcugcagaccggacucuagguuugcauccuugcagccuguuuccaaucaaauugaaagguguaacucuuuagguacuuggauacuuuuaauuuauuuacccagcuggaaugacugucucaugcugcuucucaguaucucaggauaacaguguuuaaaugauuuucuugccaaugcucaucaaguuucuaaguuguuaaagauuguaacauggugcauaagaaaguuguccuaagaggagauacauuaaaaaagugucuuuacagucaggaaaaguguuuaggaucuaaagaaggaaaagcaaugguuugguuuuuuucuucucuuguagugauuauagacauuuuauuuuuggcaauauggguaguagaaaugaaaauguggucucuuuaguauuaaugucccccucaccaucuuauuuaagcaccucauucaggguauucuaugaagaaaucugauacagucugaggacauaaucaguuugacagguggcggauggcucuugucaccacuugucuucagcuuucugacgcuggccuuucucaguucuggacaauagugagagucaagcagggguaaauagggaaaccaucuugaugaaaaacauuuuucuaaauguugaagaguaauuuugaaauuuuugauuucuuuucacacuugaaaauggaacauuuuggacaaguaacaaaguauuuauuugacaggugcuuaauugacuuaauuuucuaaguucuaucugaaggaagcaauguugaaagugaauaauagcauuuuuauaagcccagauaacuaacaguuaacuaaagguugaaaaaauuugcacaggaugucaaaauguauuuuaaaugaugacauauuuacauggagugcauaugaauauauacuaucaugguuuaaaauaauuauuuucauuuuuuaucuuuucagcauuugggggcuauuuaagugaaguaguagaagaaaauacuccaccuaaaauggaaaaggaagguuuagagauaaugauuggaaagaagaaaggcauccagggccauuacaauucuuguuacuuagacucaacuuuauucugguaaguacacauuuucugcaguaacuguagauagugccuuauugggacguguguguguguguguguguguguguguguguguguaucugaaaggaggugccuuugaguagagaaacugacugggaguuaagaaaggucauaagauuugguccuugacaguuaacaaauuuuauaucuuauuuauauagauuuuaaaagcuaguucgugaacagaugugaugaaggcaucugcuuccaauguaguagacugcacuugaaugaaccaaguaacuggcaguaaacuguuggcauuguauguguauacuuuaguauaucaaugugaucauggaaauucuuuauauuaaaaauuauuucccaugggaucacuguugccauccuuugugucgacuuuccuaaaguggagugaauaauacagggaacauuaaacucugaagauugaaccaugaaucuguggccuuaaggauugugcacugcaguuaaacuaagaggcucugccagcucugcucuguaaacugugcacaagagcgaggugguuagcagggaugguaggauuucaaaagcagagaacagaauaaaggcugggggucuuuuuguugguguaauacuuuugauuaaacaaaccuuguaguauugcuauaauauucuuuagauuuccugauaaaaaucuguuuaagccaaauguuauauucuuugauaccaguaaguuucugcugcuagucacucacaaguuauuuuauagaagcacaugucucaggagagcaagauguauuuguccuaacuaguggccuccaacuuuuuccccauguugucugugugugagagagagggggaaugagaggagggggagggagagagggaggaagugaagaaggggggagggaagaaggaaggacagagagggcgggcugauuuccaggcucuucuugacuauguaagcaagcuuuuuucaaaacauucucuugcaugucuuuacccuguguuuguggucuggaacuucagggucugugggcacacuaauggcugaacacaggccucugcugucuugacacaugaauucuuaugcauugcucuccuaugcauuguuccucuuucucuucugacuccuuuaagaauuuucucaaauaucaauauauuuuuagcauaaggaaaauauucuuuuuguuuuguagcuuauuugcuuuuaguucugcccuggacacuguguuacuuagacccaaagagaagaaugauauagaguauuacagugagacucaggagcuacugaggacagagauagucaauccucugagaauguaaguacaagauguguuugucuucaguuugcauucuguuugcuauuuucuuguguaguaauucuugcugugugcucauauaguaaaaaaagaugaauagaaauuucaugaaguauugacuuuuuaaaaccuuuagucuucugcuucuguuuauuucaguguauguaauaacuauagucuaugaaaugaugugaaucauuugguaucauguauuacaaguuaguaauaacacuguacuaaaagcagaugagguguauuauaguaauaugguguuuguuuaaaagaauauuuuuaugucuuccucuacuucuuuacuaaggugaguuguaaaugugcagaagaugggaagacuuugguaugugauguuggugauguguguuaacaucacaagauguuuaagugaugaagaguuaagucauacaaugaucaugaaacuaauaggucaggaagacagagaacaaacuacgcaauuuaaaggccaguuaugaucaauuugaauuuuguuauauacuuuucuuaacaauaaaaauaaagauuaauuuaauauauuuaaaaauaacaaaguauguaaauuaaaggaauauucuagauguccuacugugucacauaacuaagaaaguaaaagaauaaauuucucuauuuagauacuuguuuucccuaaauucuguaaucauuuuacccuuuaaaauaaauaugugcuuugauuuucacauuaauuauuuugucuuaugcaaauuuuaaccacucagauuuuucuuucacuauauaaaugguacuaccagcagaggucaaaucaauaacaagguguauuauuauagccuuccuucuuuuuaaaacacuguaagccuuucuguaauaggcuuaauauucuucgcaucauauuuguucaagcaguccggaauuguaguuagcauacuuugucacucacucuaugccaggagauugucagauggccugugaggucaggaugugucuugccgaacauggugguauaucauacaccuguaaucgcagcacuuacuggcucaagagacuaaggcaagaucaguugagcucagaaauuugagauauauuucuggugucugcaaacuuaacaccuguuguuuggacacagauuuugcuuuauugcaaguucccaaaagcagauuuuuuuguuggugguuuuugcuuguuuguuuguuugcuuaaucuuuuccuuuuguauucccaguggcaaacauuuuuacgugagucauagguauuuauuaacaagugagugacuaaaguguuagugacucuaaaaagcaaguacacgauuagugcucagcuggcucugacuugcuccauuaaguccauagucuccauaaucaaacaaagagaauuucuuaauuauguugacugguuugauugcagacuuuagauuuuuaguauaucaucaauuccccuuuuucauaucucuuauccuauauauuaaagugacuuuucuaaaauguggacauucuauuuuauaaaauaaguauuuuaauaauaagcaaauguuauugauuaaaaaccauucuccaagacuuuugaacuauuagaguuguauagugcguguuauuuuggaggugccacucuggaucucagucuuucacuuucuaaagcuuagcaagaagccugcaguugugcuuuaaaaacagcugccuagucuacugaugcgcuucccauguuaggauuguaugaaaguauuugauuacuaagauaugucauauaauucacuaugccagugucuguuaauucauuuuuaucgauauagauauggauaugugugugccacaaagauuaugaaacugaggaaaauacuugaaaaaguugaggcugcaucagguuuuaccucugaagaaaaaggugacuuuucuaauuuauuaauuuauguuacuaaacaauauguuaaauuauauccugaaguaugucuguuuuacuuaaaggguuaaucuuaaaauuauuugagagggcuauggauauauaucucagugguagaguaugcaagagacccuggguuugauuucuagcacugcaaaaauaaaugaaaaaaauuuuuuuucuaugugacaugcaaauuucuccugguauuggaagugauucuucucuuccaaagugacugugauguguaguaauuaagaaaguggcugacccuacaguagaugacuaacgucccugccgccagcagugguauuuggaguugccucuccuccuguggugagggcuguccugagccacucaacucccccaccugcgcuucuaguugaacagagcuguggaagagguggacagcguuucugucuacucacaacuggacaauuucucagauccaacuucugucuuugaguauguuaacaggguuaauauagucagcugugacauuuauacacgugauaauuacuuaaauagaaggaaaaauagggcuuauuuuaggugguagucuacugaaauccuucaaaagacauaaaaauguucucacuaugugugaaugaauauauucugcuaaaugggacaacaugacaacaaaauggaaaaguaacauuuuauuauaaccuguaaauaaaaguuuuucccuuacuaggaaaguuugaaaauacuaaacuuuuaauuaaaauaauuuugaaggaaugaauuaaguucaguguagaaauguuugucauaaagaauauaaugccuuuuaaauuuugccugugauuuauuugaauuuuuaauuuucuucuagauccugaagaauucuuaaauauccuguuucaugauauuuuaaggguugaaccauuguuaaaaauaagguaacuuucaagcugucuagaagcacugggcaguagaucuucuuuuccacugccaucccucaauaggaaugaaaucccugcugcuccucagcguuaucugaguguaguuaagcauuguaaggacagauguggguucccuuagcugccacccuuucccugggcuacacuugcagagcacaaggugaaccugcccuuugaauuagcccgagugaagaugugcccacaacuuauuuacuuaugcaauugaauaugaauauuuuuggaagcucaguuaauaagcuuuuaaagagaaucuuauucuaauugaauuaaagaagaaagaaagaaagaaagaaagaaagaacgaaagaaaggaagaaagaaaaaaaccaccugagaacauuguaguuuuuuuguuuuuuggguuuuuuuuuuuuuuguuuuuguuuuuugguuuuuuuacuuccccuuacuuacagagcucaguuagcuuuaaaauagcucucuaguucucuguuuaguaacuugaucucuucauucucuccauguugaaaauauuaccugaguuuacugugguauaguucuuaaugagauauucuaaaugucagcacuuuccaggucauuugagaggucgcagugguagaccccucucgauuucaaucuugguuucucuguugaaaauguuaggaauauuuguucugucuacuuccuuaagaucccaacacugccgaguuaguucucuuaccucugucucagugauguacuuugaaccaaugcuaaacugguuugugggaacaaggaaagugcacagugaaaguuugguacuucguaggagcuucuaacaaaugacauugaguguacauacuuaacagcaagucagagcugccauagcuuucuaugugccuagaaaaucaaagagaauuaacaaaagaguuuauaauccggccaaaaauuaaaaaguaaucauggaaaugucaguaacauuuuuuuauuccuucaagcauauagaaaauugaaaauuuuauguucuaggaaagaaaaauaggcagcaaucaaguuuuuaaaaauagaguuaaaaaaagauuuacacuaagcuaaaagguagauuugguuagugagaaagauuaaauaauuaaacauguuagguuuuuuuuuuuucaaaauaacuugcauuuugacagaauccaacuuauuguccuuucuuuggaacucaagaaaaugauuuuagaguuuucuacaaaaugaaguggguaaaaaugccgucagguuuuuuuuuuuuaaacuuucuauugauucuuugugaguuucacaucauacaccccaagccugcucauuuccccagccccuugcaaccucccccugccaaaauaaacaaaaaagaccauacgaacaaacaaagcaaaacaaagcguagaaaccaucucaucguggaagcuguugucugcgacagugugacccacaguguaccccucuguccucacaucuucacuugcaaauguucauugaagugagucacuggucugguucaugaacucuaggcuuccgugacaccaucaauauuggagcucauugggacuccuccugguugucccguuguugcuuuguuucccagagauccggcaacucuggaucaucaggacuggcccuuucaugugucccauuugcagaugacauagauuuugaggugggccaacucagagcccuggaucuagaccugggugguagcugagcucgucaacacacugccucucacuuauccacaccacugggaugagcucuccagcacugcccaggccaggccacccagugcagccuuuagcaggagggagggucagcucuccugcuccugcccucggggccugcucagccacacccacaccuccagagucagcuucuccuugaugcccagucagggggcugggcccacucugccaagugcugcagccugugaagcuuucacauccuaagggcuggcccaccagagcuuucaccaucaggguuagcucucuuccucucaugcccuuguggucagcucuccuacuacuguagauggugaggaguggaggaggccaucaccccugcacccucacuacucuacaauagaugagugguagggccagcuuuccuacacucuuggccucagggcuggcucacccaugcugcuucuccccaacccccaccacugaccagggucagcacuacugugcugaccaggggaggcauaggggccacacuccuaagugcugcaccagugaguggcagggccagcucgcuugcucucaugacuccagccagcucuccugcuaccauaggcguaggauucuuuuauuaaaaaaaaaaaggauuauaauuugugaaggaaaaacaauagacauuaaaauaguauauaauuggaaguauuuauuaauaaacuugaauaggaagguuagugguauugaaagaaaagaaauaugacauuggacaucugguagguaguuugggaagaaaacaucagguuuuuuuuuuuuuucaucuuuuaaguuuuguauuuguuuuacccugaaauguggccuuagaguaucuccauggcuagccuguaacaugcuguguagaccaggcuggucucaucugccugugcuuccugagugcuuauauuaaaugcauaugccaccauacugagacuccuuuaaaagguuuuucuagaacaaacauagauuuauuaaggaaaagcaagaaaauaauccugagaaagaagggacuucaagagaggaauaaccuguuugucuuuuagugaaauaaacugagaaugcuuaaaauuguuuuaaaauuuuuccccuuaaucuagccuuaucuaagagacaucagacuucccagguuuaauagaaguugaauacugcaguaauucucagaaguaagacagugucagauacuguucagagugugaaggccuuucuggaauugggaaaggcaccugagcaauucuuuauccucccccucacacuuccaagcaaccuguucauaauuccaccaacuccuuccuuaaagacuguaagauaguauuuugaguucuucuuauucucccaagugccauucuugucuuuauaagggaggccagcuaauagggggcugaauacugucuuaguuagggugucacugcuuugaaaggacaccaugaccagggcaacucucauaaggacaacauucaguuggggcuggcuuacaaugucagagguucagucaucauggugggagcauggcagcauccaggcagauggugcuggagaggaagcugagaguucuacaucuugauccguaggcaggcagccaggaggaggcucucuucuacaccuaauggaacuuaggcacuaggagcucucaaacccaacuacacagugguacauuccuccaacaaggccacaccuauucauuuaaaaauaauuuuaauuuuauuuuuaaauuauaugugugacugcaguguccagaggccagaagaagauguagggucaucugaagcaggaguuacaaacucccucuuguggguuuugggaacugagcucugggccucugaaagagcagugugcugcccuaacugcuccgacauuucuugccacuuuugguugugagccuuagauuuuuuuguuuuugauuuuuuuuuuuuuuuggucuuuuaaaggaugaacucuuucuccagcccaaacauacaauuuuaaagcuauuacuuuuuacuucucaucccuguaggcuuuuggccaucuuuaaugcaggauacauucauucuaacuucagaagucuucauaaucuuuaauaguuccaacacuguucaaauauuguucaaguguauggucuuuuuaacugugagccccugaaaaaaaaugaauaaacaaguuuccuaccucagcuuauagugaugcaggggaggcuucucauucccaaaagcaggaguugggggacagagcaagaaaaggucugacuaaagccagaagacaccaguacuauggccacuaaggcagggccauccaagcuccuuguagcaccagugaugacaucaugagccacgugcuccccauggagcugcaggaucuggguauucucagaugcgugaguacaggacuucaggacccaccuacuguggucugcaccacaaaggcaggcccaaaccacugcaauccaugaguuuuuauauuaauauuuguaaaauguagauguccauuuuuuaaaaguuaccaaauugauaucccugugcucuuggcuugucauaguggagaauguacaacccaacuagcaugguuugguacaauuucacagcuuuguuaugauucuguagguucuuucagacuucuaaaacucaagccauaaaguuacuuaauuuuuuuaucaguuucuaaaaauuucauaaaauuucauauuguauguuuaguaugcuuccccuauaccuccaucccuucccgucccuuuuugugucuucuuccugauaguccguuuguuccugagauaacuucauaauaaauuuguucaugucauauacaaauaaaugcuuuguacaaaucuauguaaaaucuaggaaccauaaaugagagaaaacauacaauguuucucucuauaguacugcucuaguuuguuuaauaugauuauuuccaguugcauucaauuuucuaugacugauauauuuuguucuuuaugguugagaagagcuccaguguguauuucuagcccagacacucuuguuuaaaaaaaaaaaagauaaauaguacugaaagauuaaaaauaaaaccucuuaguaguguuaguuuuaaggauuacuacuaagauuuuaagggaugggagauguuacaguguucauugugaugggaauuuguagacuuuuaugugguauuuaucaggucagugggugaccaucuaaagacuugguagcuacaaggcuagaggacaguugucagggucccugggcuuuacaccuugugcugcuuagcuugcuagaaaauuguccuucuguaccucuuagggccuuuauuuuaaggaguaaaaagaaguugaucuagaaaguauaagagucugucauugagccauuuaagcauuugcuuuaaucauuaaaagcagauuacugcuuucuagauuuggagagagaaaucgaacugauuauuguucacauaguguuucuugacugggauauuagucuacauuuuucuugugaucacagagagaacuugugaauaauuuaugaauaaggcagaaggaauaauuuaugaggucuucugcauaagugcauuuaauuaucucauccaaaucauugucuuuuaccuggcauuggaugaugcagagcugcacaucuguaucaugguauuauauucucagguccugccagguggcuugauauugugacucagucauuuagcuuauguggauagcuuaugugcauuucuuuuugauacucuuagaucagcaggucaaaaaguucaagacuguaacuucuaucaaauuuuuauggaaaaaaaugagaaaguuggaguacccacaauucagcaguuauuagaauggucuuuuaucaacagcaaccugaaauuugcagagguuagugauucugacuguuuucuugguuuuuuauuucuuagcaguggucagaagggggauguuaaacucagggcuuguacauacuacccugagugcugcccugcucaaccacacccagcucucacucacccuguuaagaaaacccacacaaaagauuguguuccaacuuuguucuuuuuuaagaaagcucuuuagcuuaaguugaaauguuuuggauuuaggugcaaaauggggaggaaaucuaguguuuaaccugaagaccuuuaaaggugcuuaauuccaaagauaugcauauacauauacauguuuauguuuuuaguugucauuuuacccaagcauauuaucuaaacauuuagaagguaaugaaugcuauuuuucucccuuuguuaaagauaaaaugccagugaaaucuucuguguggguuuguuaaugaauguaauagaagacuuucuuuuaccuggauggaugguuuccguagugcaugccguggucuguugcuggaacgcucgucucacuuacucugcugauguauagguagcaucuucugugaugaugucagacaggagagucaggagguccuguagcucacugcugcucuguguccacacugcacauucacaugugggccaacagcguagugcugaaacuacugcugggagugacagcugugacuacuucaguuucagagggaaacuuguuuuugcaguuuuuuccccuuagugcaggagacaagacucaaagcugugggcaugcuacuauucuaagcugaggaggccccagcccuguaggacugugauuucuaaaacgauguaucuguuguuguuguuguuaucaauaacacuauuauuuuuauuauuuguaggcaccaucaugcuugauuauccagaugccucgguuuggaaaagacuuuaaacuauuuaaaaaaauuuuuccuucccuggaauuaaauauaacagauuuacuugaagacaguaaguuacaguccuuaguuuguuuguuuuagaaauagucacauugguuguggauauaguacuuugacaugcagugcaguaccugaagagcuuggacauauuaagccaauaauuugagugcugagaauuuauucugaaaagagaagagguugaaaacaauuuaaaugcaaaaucacuuaucauuauacgauaagaaaguagagacaaguaaauguuagugagaggccagagguuaauaggacuauucuucauaacaauagagcuacuaccauuaaacacaggaguaugaggacaacacacauggaaaccauuguaaguggaaggaaagugcauugggagacugaaugggagacaugcgugaaaugcacaucacuggaugcacacagguauauagauaugcagacauacaaguguuagagaaaguuuauauaauggcaguguauuucucuugcugacuaagcucauaugugcuaucaguuuucuuuauacuuucuuuauaucucuuggguauuuuaugaccagagaaacagucuuagaauagguuugaaaaaaauccuaaaaauauuacaaacacaggaaauccaaaugaaauuuuaagaggaucagaagggggcuagcugcccccccagagcauuuuuagugacagaauaccuuuuuuuuccauuuuuucauuuaauuuauuuauucacuuuacaccccaauaucagccccccuccucccagcgccccuucacacacauagauccucccucucucucccugcucuccccuucuccucugagaagggagagcucguccucuccgagcaucacgccccaccuuaccccagcacaucuuauuuagucacuugacauuugccauccaucuugaaggacuguuucacugagcacagaaugcuauguucacaggauuugcugccuuucacacuaccccuggcuggcuggcauagucucuaaugagaaauucgcaguguuugggucauuguuugcagcuucauaauuuauuuuucucugccugcuuuguuuuuuaauuugauauucucuuuauuuacauuucaaauguuauccaguuuccugguuuccccuccgaaaacccccaaacccucccccugcucaccaacccacccacucccgcuuagugcagaguucuaucagaccuucaaagaagaccuaauucuaauucuccucaaacuauuccacaaaauagaaacagaaggcacucuacccaauucauucuaugaagccacaauuacucuuaauaccuaaaccacacaaagacccaacaaagaaagaaaacuucagaccaauuacucuaaugaauaucgaugcaaaaauacucaauaaaauucuugcaaaccgauuccaagaacacaucaagacaaucaaccaucaugaucaaagaggcuucaucccagggaugcaggaaugguucaauauaaggaaauccaucaauguaauccaccauauaaacaaacucaaagacaaaaacuauaugaucauuucauuagauauugagaaagcauuugacaaaauccaacacccuucaugauaaaagucuuggaaagaucaggaauucaaggcccauaccuaaacaugauaaaagcaaucuacagcaaaccaguagccaacaucaaacuaaauggugagaaacuugaaguaaucccguuaaaagcagggacuagacaaggcugcccacucucucccuaucuauucaauauaguacucgaaguccuagucagagcaauuagacaacaaaaggagaucaaggggauacaaauuggaaaggaagaagucagaauaucacuauuugcagaugauaugauaguauacuuaagugaccccaaaaauuccaccaaaaaacuccuaaaccugauaaacaacuucagugaaguagcuggauauacaauuagcucaaacaaaucaguggcuuuccucuacacaaagaauaaacagguugagaaagaaauuagggaaacaacacccuucacaauagucacaaauaauauaaaauaccuuggugugacucuuagcuaagcaagugaaagaucuguaugacaagaacuucaagucucugaagaaagaauucaaagaagaucucagaagauggaaagaucucccaugcuuauggauuggcaggauuaauauaguaaaaauggcuaucuugcuaaaagcaaucuacagauucaaugcaauccccaucgaaauuccaacucaguucuucacagaguuagagcaauuugcaaauucaucuggaauaacaaaacacauaagauagcgaaaacuauuaacaauaaaagaacuucugguggaaucaccguccuugaccucaagcuguacuacagagcaauugugauaaaaacuaugguauugauacagugacaggcagguagaauacuuuuuaaaagacuucuuccuccccuuucugcaaaugguagcucccaggcagugccgcaucuguggaggacuugcgauguacgagugcagggagugcuaugacgauccggacaucucagcugggaagaucaagcaguucuguaagaccugcagcacucagguaaucugugcuuaccugguggguaugcccuguagacgucacccacugacuguccacuacauuucuggacuugaaagccuuucagaaucaaaguacauucauaguaaauguucuugcucaucucucuucuguuggugugugugugugagagagaaauacuuggcugugauuauaagagcugggcucagugaaaguggcuagagucugcucccuugcaacaugguauuagcucaugugguguuuucuucauggucccuuuuagguucaccuucaucccaggagguugaaucauucuuaucauccaguaucacuucccaaagacuugccugacugggacuggagacacggcugcauccccugucagaagauggaguuauuugcuguucucugcauagaaacgagccacuauguugcuuuugugaaguaugggaaggaugacucugccuggcuuuucuuugacagcauggcggaucgagaugguauuaaacaccuuccucagcauccuguauuuagggguguagugcuuccuagugagaacaugugugugaaguaauaggguguguugugagaaaauccuuuaaggaauaguauggugcuauagacuuuaaucuucaaaguguauuaauaauucagcuacccagacuaaggaacaauguugugacaucuuggcacuuaaacagauuuguuaaagagugcugucuaagaucucagcacuugggagguagaggauugugaauuagaggccagugugugcuacauaaugagacucuuuuuccauuugccccaccucaaaaaaaauccuaagauucuucuuuuagagcugauuuuaccgucuauuuccuuucaguucuguauacacuguaguagccauuuauugagcaccuguaugccaagcucagugggaauacugcaguuguagaaauuaugccuguuuuucuguugucuuaguuaaaguuuaaaguggugaagauugcaugguuugcauuuaccucauucuuccugaucuccugcauuccguuuuaugaagaaaccuuuaucuaaugagcuguuccuaggaagcuuagucauuucuuaauacacaguucagugucaggaccucaaaaaguuuuggaaguaaaauacuugucacaguacacccaaccccccaaccccuauuucuacagguauucucccaagcucuaggcccuaaggucuucuggugugggucucuaauaaccagagaacccuaguagcaccuccuugaccagggacacaagaccagcaguucuccaucucuucccagcaguucaacgccugaggggcaugcccaccccuccuguucauaugcuucacccaguuagcauuagcagcauggcuuuugggaaagcacuugggagaauaaaaccaaacaggcuuucuguaauccagucaucaaagcacacaaaguaaucagugugcuuucugcugaucagugcauaaacagcgcauguagaggugugcaaguauguccuuaaaacauaggaaaacagcaaugggcauuacuagguguuucaaaaacugagcaaaauuuuuguggaaaagaaugucaggcuguuaguguaugggagggacuugcagguaugaggaaucaagacugugcacacaguggguagcagccugcaaaucaggccuaucuuaaauauguguucuuucaccaguuuuauucaccuuugccuguggaacccucucagaagccaaggagacuauaauucuagaaacuggaagucaaacaaagguuuucuuccaauucucagagucaguacucauuaaauucuaggauaguagaauuguucagguaggacaggaugccagaaggacuuagacauucacuucccuaaauagauuucacugccccuuucucuagguggucagaauggcuucaacauuccacaagugacgcccugcccagaagugggagaguacuugaagaugucucuggaggaccugcacucuuuggauuccagaaggauucaaggcugugcgcgcagacuucuuugcgaugcauacaugugcauguaccagaguccaaccaugagccuguacaaauaaccagguuauccgcagugggcagagacagcacaaaccuuagugcugugucuuccuccagcuugugguucuguccggcacccauugccggcaaugggugucucuuuugaugauggcccuucagcaaaggauuccuguguuuccaaacaaauugcuuuuguguuccugaaguauuuaauaagaagcauuuugcacucuaggaaguauguuuguguugauuuuuuaagaagucuaaauggauuuauuaauaucugacacuuuaaguuaacugcauugaugauacgauauuuuuggaagcauacaauuuuaauugugacgucuaaaaccucuuuuaguccauugaggauguaaauaaauauuucuucuuauggaccagggauaugaaaucauuuuccuuuuguagcuaaugauugccuugagaaagacauaauaugauuuuauuaagagucugccuuuacuccaauuguugaaggugugcugaguuuaauuguuaauuuuccuauauagugcugauuuccugcaugucuguacuuugcugaguuucuguguuccugcagcaguggucagaacaugcugaaauuccuuucaugguguuauuuuuuauuuguucuaguuuugagauaaaugagugacucugucauaaaauguccauuuuugauuuguucuugaagaauuaggguacaaaacaaguaucguagucauaguaacaacuguuacugaacaggucuucuguaggggcuccuaaguaugagacaacaugcagugguuucugaaaugacugagcgauaaguaaauuauauauucuuuuuuuaaaagauuuauuuuauuuauaugaguacacuguagcugucuucagacacaccagaagagggcaucagaucuuauuacagaugguugugagccaccaugugguugcugggaauugaacucaggaccuuuggaagggcagucagugcucuuaacugcugagcuaucucucuagccccaaauuauauauucuuauacagacccacaguccagagaaagugaagcuggcucagaguuagcaccaacauuucccugaaaaaauguguuagguguuuaaaaaucucaucguaaauaaauuauuuuauuuuuaguuuaagugaauuucucuuaauuuaaauaagacuaauauuuuuguuugacugaagacccuuguacucucuggugucaguuuggugucacuugaaacaaugacaaccacgucagcauguuacugcaaugucagugaugguuucaaaggagaaaauggaugucaucuuaggacugcuuguguguguauagaccgugguggaugcuguagagugcuuguugucugaguguuguuuugugguauggcugucucucugaauaaugucaaccuuacagaaagagaagguguuauauguguaacauauggcuuuauaaaagauuuaaugucaaaagagucuauaaauauugcuguuauuuuuaaaggcacuuuacuccuugguuuuauuauuccauuuugcuggcguguauuagcuuuauauaaaucacaacacacaaaacucguccaucuuguaaucuuuguacuuuugcaauggaaaaguguguauacugugcacagacuuuuauauagcugagugccuagacuggguggagaggccaugaguagauagcaguaaaguccuccagcuauaggcuagccuugucuucaucauccugggacaggugagaacggugagcacaggugagucugagcuugcacacugaccagaauucagucacccuguaauaaguauguauuuaaugagucuguuagugugguagugugauuuugaaagguuuaacuaaggaauggugaggucuuuguuuauaggcaagccuggcuuaacagugaaggggagggggcugagggaaagcuuuuuuuuuuuuuaauuucagaaauggaagcaaaauccaugugcaaagagacuagcuacuuggcuuucagagcagaggacucaaagcuuguuugcagugguucugaaguugggguggcacuuugugagugaggaggaccauguccacaggcaaucccuaagcaagaucgucucgaaauugcacuguguucuuuagcaguaguggcuggguaggggcacacagcggaacacccacuugcaguggcuggggaggccugagaagcacaggccagcgggagcucucucccaugccuucuugucccucuggacagccccuccucauuccuugucccagcagagccugguuugccccuggggcaauaggguuggacuguguggugcagauagcccucgugccuguggauuacuuuaauuuuguaaucuuagguuuucuguacgguuuucccauugccuuuuaaaauauuuugaguguccuucuccuuaucaagaugguaguguaguaggauuguuuuacucacaacaugguuuaggagccauagcuacaaauaggaaauauaagaauucuauuucucuacugugaggcaaaucuguauauauguauggagagucaggaggaugaacaagggagaggaaaggggcccaggcacauuuuuaauccaaaagcuacaaagugucgagcuccucagggccagcuucacagagaguccagcucaguucacaaaguauuuucuaaguuggggaaaugcauugagaaacagagcgagauaucuguguagugcagcugugggugguugcuaugcauuuuauccucagaguagccugggguuuuuauuuuauguuugccaagugcuuagguaaauggccgggcuccucuuaccucugacuucuggagcguguccauucucugguugacugaauguggcauuuucauaaaucuaggagcagcagcccucccaacugcaauuuaguaagcagguagauaagcuugcaucuguuugcaucuuccugcacugaguugggagugcaaaaccccguacuuggccuggugaguaacugccaacaaguauuuaugggucauuugcuagguggcuagcauacggcacggggcuaaugagaccuggggccugcucucauauagcuuacugcucaguuucuauaccagagcauccguuggugcuucuuagccuaggcaugggugacaggcaugucuggggaccacuuugggagacaaccuaguguaaccuuauugcaaaggacuaagagacaaaaauccuggguucuuucuccaucacuugcucuguagcugaaugaacaccaccucgauuucuugaguuucagugucuuguucugucugaugaaaggguuggauauguaguuggauaagcgguacaaauuguuaggguuccaggccaugccugauacaucugaguuuuugcuggagguaggaaauuucaacucagaagcucauccacagaaaacagugaccagcagcagguauggagccauaaggcuggaaggcuucaaagaccccuucuucuguuacuguuauccacggcaguuauucuguguaggugugaaggaguggcuacugacucuguguggaucagcguuuacauaugaccugaugggagugcaucugguauguguuccuccccccuguauugcuggagagauuggcaaucguagguauacacggaagugucgggauguucaguggcgcgcacuuggauguuucuuuucacuuuauuucuauagaaacagguuccaggagccagagaaguaggggaaaaaaucccugagcucaucucucucuacuacuuaauaaugcaaacauuuaaauucuugggaagauuuucccgccccacucccuacccccagucacaggucagaauaggauuuccuucuuagagaagguaggucauggggccugcgauuaaaaaaacaaaaacauaaaacaaacaaacaaacaagguggcuuuccuuggucuuugugauuccagcucuucaccagugaaggaauucuuuaguuccauagugcagccuggguggguggagaagaggcuguuauagugggagccagugagcaaagaggguuggaggaggcagaggacagggcucagggaaggcaagccuguggcucugggcauuggcccucuugucaaaggugucagagcauggcuuccugugaggggcuuucccuugcuccugugugagaaucugugcguugucuuacuggaugggggaccuggauggagauguuaggggagauagcuuagucuuguucuaaacucuagacuugcuaaaaaggguucucuugaguccaaaugcagugccagagggugagaagcagaauuggccaguagugaacagugguauugugggugauaagcccuuucugguggccuuaaauagcagugcuaguccuugagugccacaggguccccuaccuccguccuggcagugcugauggguuuguuucagcauauuuugguucucauucucauuuagggaaaagggcuguugaugaagggauuauccucccaggcaccaggggccucagcacaguucccugugcuuuuaaacacuguugacuuucauuaguuauucuaaagggauuuauauuggagauacaacucccuuugguuucauauuaugaaauagcuuuguacuguggaaugcuaacucuggaaagucucccucauaccagaaccaaacauucauuucuuuuauauauauauauauauuaucucccugguacucuccagggaggugguuauuaucaagcugacccaaaggagugcaguauguguucuaguuccuuuucugguaccuuguucaacauucuuuuuuccugaagaacauccuuuuguuuaugaaaacgugaauagcaucauguaaaacaaucccuugcuaucagaaugcuccaguuuggccuuaauuuuguaaaccuuggagaggaguggagcgcggcugugagaagagauguaccauguacucuuucuguaucauuaaagugcaguuuuuaugcuuc

SEQ ID NO: 12150 - RNA, 26094 nt, Mus musculus
cccagccggccacaucuggcgucugcccgcccuuguuuccgcugcauccagacuucccugguggcuggaggcucugugugcauccaggaguuuagauauacaaagggauugccaggaccugcaagcacccgcggcagugguguguauugggacgugggaccccguuaugagcuccugagccccgagaagcagaggcaguagaguaaggggaucgccgugcagggcaggcgccagccgggcggaccccagggcacagccagagaccucagggugacacgcggagcccgggagcgcaacgauggaggcacgaguggccuggggagcgcuggccggaccucugcggguucucugcguccugugcugccuguugggccgcgccaucgcugcaccaucgcccaucaucaaguuccccggcgaugucgccccuaaaacagacaaagaguuggcagugguaaguugcuaugcuggcuuagacaaauuuaggaaauagaagacgcaggccacccucccucuucugacccccucuacuggcacacagccuugggaggaacuuugguaaacaucuuugagggucucuuucuuggccaguugauggagagguuggcuuuuguaaacaacgggggugggggugggggugggggggaggaggcuuugguaagaagaggccacugauaaguaaguugggggaguucaggguacguccaagggaccaggaagaagcaaaggagggagaugauugcccugggaaacaucuggaaaggguugcuuuugugaauaauagggacuuugacuacuuaccuaagggauuugguucuaggagggcuuuauaaaugucuuuuggacccaacaggagagcuggcaacagaaccuuuggcaagcaucuugucaggccuuuagggcaaucaguuuaagggggaaucucuugaaaauggggugugugcuuucgcauauaauuuguauaagccuuuggccacaaaaggauagccaaagcaaggcuuggcaaacuucugggaaacuuuggcacacaucuagagacaggccuuuggugagaugcuggaagggaccauuuggcaaguaauuugaggcuggagggaagcagacugugcauuuugagggaugucuuguuuuaaugcagaaguuguccaggaggguccaaggagaguuucuuugaacuuuucccugggaucagaggacacaaggaaacaacgcgccuggcuggcaggccugaggagcaggagcagaaggccagggcgcguggggcgggggcggacugagccgggcuggggucggccagcggccaguaagaccuccuucuuggccagacuccagagcugcggcuuaguuguugugugagcgugcgccuggcucuagggcguccuggcagcagcauccaucgcauccaucacauaagcuagauggggaggcaacugcaaagcgguacccacucuccauccacuggccauggguugguuuagaugcuuugcugggucucaggacaugucucuuuauugccuuuauucaaucauuuuagaaaucuuccagucagccucuuccccaaucuauccaagacuaggaaucacaugccaugccgggggggggggcggggggggacaccaaaucucuuuccacaaggcuuccuuuacagcaaugguucuuaaccuguggggcgugacccuuguguagacggaaugacuccacucccuaaggcguccauauaacagguggagagagcucaauaagguggccaaggauggugcacaccugggaagaccgggacaggaacguacuggguucaacuuaaagugaaaagccgccccucccaaaagaaaacaacaaaaaaaaaaagaagaaaggaaggaaggacgagagagagagagagagagagagagagagagagagagagagagagagagaaaauaaagaaagggaggaaggaaggaagguaggaagggggaaagggggagagagagagagagggagggagggagggagggagggagggaggaaggaaggaaggaaggaaggaagggagagaaagaaaagaaggaaggaaggaaggaagaaagaaagagagagagagagaaagaaagaaagaaagagagaaagagggggcuuuuaacuuacaugaucugacuuccugcacauccuauguuaaccuacuggccuggugaucucuaaugacugauuuaacuuccagaguggauguuucuuugaagucagagggucauaguggcaccaucuuugugauagauggucagguacuucuagauuccuggaagagugucuggcgcuuaggaaacacucaauacacaucaggcauuguuacuauuacauuacuauuauggucauuacuaucaugcccucuuuuugcccuuugcugagugccuccaagcagguaagagccagucuagaagccggaacuccuagcuccuuuugccauuccagccagacuuccccacguauuuaaguuugcauuugugauucacccacauucuugcgccaggguuugaaccuuacagaguaaaagugccugucuugaucaucaguuuauccugcaguagcacagggauugacacaugguggccuucacacauugcuuguugagcagcugguuguaguuuggggcagaccaucuaaagaauaaggccagcaucuuuuuagaaaugguggagcuaagauuugaacucaggucugcuaccagacccaugccagacacaauccuuaaauuucuucauaagaaaaaaaaauaugaggaaaauaauguauuccuaggucugcugggagguucagucagauagaagcuggggucugaggguucaagcaugggcucuggagcaugaccgcuugaugucaaaucccgauuugccauuugugagugguguccucuugagcaaguuucuuaaguugucugauuuuuuucuuagauucuuccucuuccucugcacgacggggagagagagagagagagagagagagagagagagagagagagagagagagagagagagagagagggagagggagagggagagggagagagagagagaguuacauaagcuaauaucuacugaguuauaaauucaaggaaauaaaaggugguagcuaugcccuuuacaagugaaucaccccacuggugggugacagaacucauuugaaagcccaaggcuccauucacugucuuuagauuccugguuccauccugucccaguuagugaauguuuggcagaaguugggguuaaugggcauugccaucccaauguggaucccgacuuugagaguuccugucucuuucagcaauaccugaacacuuucuauggcugccccaaggagaguugcaaccucuuugugcugaaagauacccucaagaagaugcagaaguucuuugggcugccccagacaggugaccuugaccagaacaccaucgagaccaugcggaagccaagauguggcaacccagauguggccaacuacaacuucuucccccgcaagcccaagugggacaagaaccagaucacauacaggugcccaggagggucuggggggacacagagucaggacccugagggaugugugcuuccuugggaauugccuuccuaguuuaggggauccaugaggugucauuccucagagcugagcauucagggacuuugcauacagaguucuugauguguggcuagguuugagucucauauucacuaaugauugaggcacuggucuuacucucuugcacuuagaguugguacccuugccaaugaaacagggcuaagaaaucugcuccucauaggggcgguugaggagcuacauuagauuaaauguaaaucaaagguuuccacaauguuugauacagagcaagggucuacaaguguuggugauugucauugucaucugggugggucacugggucaaguggaggaagcuugaugaccagcugauaauuguguucuuaaucuuauagugguuuuaugauugguugcuaauugagccaagaccucuccucuaugugccugguaucgaucaagggugagaucucugccuuuuguuugauauuguacuguuuauuucucuggugcccuugucccagacagaaugagggaugagaaggucugagauuguagagacaucaaggcaguauaggaggguguucucagugaguuuugcucaacacaucugcugcacgagaacacuugcacacacacacacacacacacacacacacacacacacacacacacacacacacacaugcacacacaugcacacacacgcacgcacgcacacaugcaugcacacacucuaugcacauagacacuugcacaauugcauauaugcacagucguaugcacuucucccccuucuaggaucauugguuacacaccugaccuggacccugaaaccguggaugaugcuuuugcucgggccuuaaaaguauggagcgacgucacuccgcugcgcuuuucucgaauccaugauggggaggcugacaucaugaucaacuuuggacgcugggguaggcagaacugggcuggagaaugggguagcacagagacaacagggcuagguagucauuugagaagcauggggaucccgagggcagcuuacugagaaguguagacaucggaugcucaucagauggagguagcagagcauguuccagacacuggaaagccacggcugugauagcagaggaugcaguauaguauacccugcuugcagcaaaaacggacugcacccuguaaaugacagccccuagaugcauauggcuacuuggauauaacauaauaagaaagaccuuaacaauuuaaauucaguagucccaauagcaaugcaggaggaaguggaauagaaucuggggccaagcuaccaugugagcuguugguaucuggcagcaguauacguaugaaggcuggugguauggauaugaguagguaaaacaaugaagguggagggcaugggaaaggcaauguggaccuggggguaaguaagggaaacauucuguuacaguagaguccgaaggcuagcucuguggauagugaugacugucuggcaugagaauagagcauagugaggaagauggaguugaugggaggccauggaugccaggaagggauugggcuaucaugcugugguggcacugaagacauguggguggguacaguguuccugauagcaaugaacagagcaaaggucuaucuguggugcaggggagaggaccauguguccucgaggaguaugggccacaggaugggagcaaccaagcgagagcuuuuccauugacucccagugaugcuuauuccauaaaaccccaguaggaaaugugaaagggacagguauuuggagggcugaggaacuccaaacacagauaaggcuguggcugagcuuaaggaugcagcugugggggcagggaaugauaacagcuaagaggcaauguggauuucagagcauggagauggauacccauuugauggcaaggauggacuccuggcacaugccuuugccccgggcacugguguugggggagauucucacuuugaugaugaugagcuguggacccugggagaaggacaagguaagauagcuuccgucagccuucauuccugucuccuagcaaucuaaccccacuuucagcccuucauuugcucugaugggaucagggcaaugggaggaggagggaacucagcuuucaggaugagcccauagcgcaaggcccugagaggugggucucaggcucuguguguccugcagugguccgcguaaaguaugggaacgcugauggcgaguacugcaaguuccccuuccuguucaacggucgggaauacagcagcuguacagacacuggucgcagugauggcuuccucuggugcuccaccacauacaacuuugagaaggauggcaaguauggcuucugcccccaugaaggugagcaucugcccuggccccagcccucacccuacccaggcccucagccuagcuagggguaccugccaugccuacauccuccacauuccacaggccagccaaccuucauccccucaucuaaguguccauuauccugcuuucagcugucacugugucccgccucuacuguguugcuuuaaggacaggcacacauucuaagaaguguguugcucaaguucaucgucacugugugaacauaguauccugacacaagcugagaagggaacagagucuccagucagucugaccucauggaccacugucacauaggacucccacccuguguguguggucuguuguagcuuaaaugcuauuuuuguggugcacaaccauuucugcuuacuuuuucauauuuagauaagugacuuagcuuuauuauuugugagauuauggauuugauuuauugauuauuuuuucuaacauaugggagaaugauuuugaauguaucaacauuuuuuuggagggccacuuuauacuucauacaaacucuaugguucaaggccaggaggccaggagaagagagacaaggccuagagacagaugaagagcuuagcagugggagaggaacaaggcucaguccaagcugguaccugauccaaggaggaucuucagucugagaauauuagccaucccucccaaacugggcccacuguaccaaagagagucacuuaaaguggucagagcuaugccaucugacucugccuucugucccugugccaggacagguauccagcuccauucaguguguguguguguguaugugugugugugugugugugugugugugugugugugugugugugugugugagugugcauucaucagagcucgaaacauuuucccucuucuaccaucuauugaggaaaaagugugaagggcagagggguauugauauccacacucaaucuacuuugaaagcuuccuggacacacuuucuaaucauaaaucuugguaaaaguaugcaugacaucauacuuggccaggccaucucacuugaugguucuaaacaucagaaacccagaaaaaaaauguuggagaaaugagagaaagaaaauacagaccuacuucuaaguauuaguuuauuccccaacucauaaaggcauuucuggaucauagacuaaggacagucuguuugggguaagggggggcuauaauuguauauaauuguauaugguugugacucuuccugccccuauugcaacauaacaguagcaccaaucaucuggacaggggggaaggaacaaagagcuucuaauugccuuccuguuuacauuuccuuuccucugucuuuucgaggcagauccaacccauggccucacacacgguagagcugaucuccuccaccacagacuucuauccucagccuuguuuaugcuuuuaucacggaagcuaaacuuuguaguaagacucaagcuacugacgauuaguaagucagagguucuaaaauaaaaaucugugucuugcauuucccgguuggacaugggcaaagcacagaaacccuuuccagagucagcccuucuguggauagauacagguuccguggauagauaggaaacagccuugaacaucucaagcuuggacagguucucucugugucagacauuggcuauugauuugguccucggccagguucaaguacgcacaaggcacacguguuugggucuuggggcagcgauucugauuacucagccccuccugacggcugauucagugucucuucccugaccuucucuuugggaagagggugggucccagaggagaugggcuucugggugggaucaaaguuaucacuuaacccuccugauucugaaucaccagggccucuggacuuagaucuaucgcuucucuaagcuuuacucuuucugguccaucagggaaaggugucuuguuugggggggaguggagaauagcaaugaagauagagacccaccccccgucccugcacugggaagccagggguugaguucuauucagcuugugguagaguuaacagacccagugaggucaccccuggcacugcuguacacagaugguccucguuacgcacuugugguuuugcuaguuggcaauuccagacacacaccauuuuguaacuccagaguggaugcagggaugggagccuugggggaucucaagacaggcugaccuugauccggucucuccccauucuccagucaugcccuacccuguggucaucagaguaggaggcuaagauaccagcuaccccuucuccuucuccccuccuuucuguggggauuggcuauagcaucaguggagauguccagagaauacugaaacuuucucgagaagucaguguucacugguauuuuagauuuauuuauuuauuuaucauuuuaaacuaguguagguguguaugucuuugugugcguauguacagaugaguguaaguaccucugaggcuagaagcaucaaaucccuguagcuggacuuacagaugguugugaauuauuugacaugagugcugagacccaaacuuggauccucuggaagagcagucauugcuuguaacugcagagccaucucuccagccucuagagauuguuuguaauuaauauuuuuaacagcuacaacuacucuuaaaugaaccagcaagugggugacuagccaagucuacccagccaguuaucucucucaauggcaucuuuucccucucuuccccuccccagccuuguuuaccauggguggcaaugcagauggacagcccugcaaguucccguuccgcuuccagggcaccuccuacaacagcuguaccaccgagggccgcaccgauggcuaccgcugguguggcaccaccgaggacuaugaccgggauaagaaguauggauucugucccgagaccgguggguaucccugccucucuaugcuccucagaggcaagcauuuugacauuuaauacccacuuggcuaccuacagcaucuuccccaagacuagcugugguaccacaaaggcgugggagucagcuguugcaggugugcuauugauuccuggccagcuggcucacagccugcuagccaguuugcacccagucuuucagcucugacacuguaucucccucccucugaccuugaaucuuuccccucaccuucucuugacugcaucgcuucuaugucucaucucuuacucauccuuucucacuguucuuuucuccaacauguguuuacugagccugcuucuugaagcuaaagcagagauuugcguuuguaagacugugugccucaaggcucaucuucuagggcaguguguugagaccaucugcucucucagcccucugggugucuggccucucugcuccuaucuacaaggguccauuucuagacucugaacuauggcuaccuggguuuaaaccuugggucugguacuuaacuuucaaguauuaucugcguagcaaguuucuuaaucucuuugagccucuucaagacaagucccaucuaugacauggagaugucacuauagggucucuccuaugacagggcuauugauggaggugaauaggauggaccaguacccagugagugcauguuaaugucaccgucuugucauugguucccgacuguggccucagauccucugcugccucuugaccucugucuuuuaccccccagcuauguccacuguggguggaaauucagaaggugccccaugugucuuccccuucacuuuccugggcaacaaguaugagagcugcaccagcgccggccgcaacgauggcaagguguggugugcgaccacaaccaacuacgaugaugaccggaaguggggcuucuguccugaccaagguaugaggcccuggccuuuggguagagacacuggacaccccuccacaccugaccuggaacaaccugagguccagacgauggaucaagcauagauauugucucuaaacaagauacccccauuguaccuucagaucuagccuucagagcagaggaaacucugcuccggcagggaagacagguucccugcuuagguccagacaguuuagguggacauucauacagcuucaaaaugagaugacuaggcacugacccugaguggggaucagcccugcuuuugcauuucuuaccuaccacuccagcuacccuuccagacaggacugucacuagcaggagucauugaaagaccuuacuguuggucuuugagcugggcaaccuucacugccuagaugcccaggacuucaguguuucagguagcccaaaauguuuaggcaaggggauggguccaggaucuggcagaauuagguggguuucuauucuagauugauuuuuguuguugugaaugaacacuuagggaggaaagaucuacaaagaggcuuacacucccagauugagggaagucagggcaagaacuuaaggugagaaccuggaggcaagaaccauggcaggauagcacuguguaguuagcucacaggcugauggcaggauagcacuauguagcuagcucacgggcugacgcuuagcuugcuuuccuguacagccuaggguauaugcguagggaacggagcugcaguaagcuaugcucucugcaucuauuaauaauaagagaguuccucggcagcaugccuggagaccaaccugaugaagaucaacagucaacugagaguuuuaacgaugacucuaggcuguguggcauggagaguugaugcucaccgggacacucuuccuucugugaugauugcuuuucucuuguauugaggugcacuuuggugaaugcuggccaaaugagguuuucuuaggaauuuuuucuugcccgccaaaggcuaucauaggagauagucugacaccccugcuuggugcaacuucugccuauggugagaucuccacccaugugaagaguuuguggccacucaggcugccacguacaaagcauaauauacugguggcuuaggacaacauaaacugacucuuccccuagucagaaggcuggaaguuuacaaccaaagugucucuccccaucccccuacccccacccccaugccuguaucaccuuauugcccgcuucagccauuauaugucacucucuggucccuaucggucccuuugucucucuuccuaagagguuguaauccacaguggguuaagggcucguuggcugcaaugaggguagcauuuuaacugauucaucuauuugagacaggguuucacuaugcagcccagauucgucuuaagcucacaacccuacuucagcaugucaagcacuggaauuauaguuagauauaucauucuuggcucuggcuuccauuuuggugaugucugcaaauaagauggcauguccuagguaaccagggacagaauucuauuuuauacuaucaucaucaucaucauuauuauuguuguuguuguuguuauuguuauuguuauuguaguggggcuugugggauaauugagucacagcacggaggguguggcacacgauuugccugcucuccauggccaagccugagcaagccauacaggcaugaauauguuuuguuucaguuuccccaugggacuggauuugcuggcauacacuaggcgaauguuauaucaucaagcugcauucccaggggaguggcuuuuacuuccuucccugggaagaaauggugaaacccugaggccagacucucccucucacucuucuucuuugagauccugagcagcagguuuugugucaacucucacaaagggcuaaaaagcaugcuuuuucacagaugggacuugaagcagaugccccuuucucucgcccucauaccacaugcagccaucauugggaaaaggcaagaggaugcugacuggccuacucaaaagcaacagcacucucagcacaagggaaaaaccaauaugugccacuucuagaacuuuuagcucuacccuggaguuguccucccccaaaccuccuuccuauuaagcaagucuugaugccugucuuauuucucucuugaauuccaccucaugucccugcuuuggcacucaggauauagccuauuccucguggcagcccaugaguucggccaugccauggggcuggaacacucucaggacccuggagcucugauggccccgaucuacaccuacaccaagaacuuccgauuaucccaugaugacaucaaggggauccaggagcucuaugguaagccgcagcuugugggacucugaggggagaggugucuucgaggaucccacagccugggugggaagacgcaggaguggaaaaugccagaccucaucuaguuagaauggccagggacaucaucaggggacauggcucgugccugguccucaggcuuuagaguaaugcuccaaagggcuucugagacagcucuguccuuucuagacucuaguuauccaugccucucuugguucccauuuccaugugcuagguauaugaacugaggcuaagaaaggcguuuagcccaauaucaacuagguuucagcagccagguaggguuuaggauccagaagagggagcugccuacagggcagaauuuucucuggcgugaaauggguguuacuaguucuuguaagaugcucauguuucauuuugccauagaaacauaauaacugcuuccugccaccaaugauggccuauugucugcgcuuucagugagguuagaggcuaaaaagcagccagucaauuucuuaaaaaaagaaaucaauuauauaauaguccuagugguuccuggaccaagcgcguggugaaagugaaaccuggauggggaagcucacggacucugaacuugggaaagaaucagagaugcagacauugaugggugacauugcagucccgcuaaggcuacaugccagcuggaaugaugcaacuguucgccucccuagacuccacuguugcgcagccugaggaguacaaaagcaaauccuuaagaaagugccacaccucuacuggcaccagccagccuucucuguucuuaaaguaagagaccacacaagagucaagcgucuggucccuucucuaagcucaggcucuacccagguagacugcucuuuuuuuuuuguagccuuagccaguuaagugaguaguacagggguugagccuggcgaugagaagccuuguugcuggguagagucuagggucaggugucuccccauucccuagggcccucccccgaugcugauacugacacugguacuggccccacaccaacacugggaccugucacuccggagaucugcaaacaggacauugucuuugauggcaucgcucagauccguggugagaucuucuucuucaaggaccggugagugagguugcuuuugucuuucuuacccucuaaccucuguccuuucccauuguucuugugcccccacuguuguggagggcuccuggagccucacagaaugaccugcaguaagcaguuuuugcuugugucucacaacccacagcucuugguagcuuacaauucaaguggcucucuugaauucugggucaaccagauaucuaagccuuugaaucagcaggucugauauauucuacaugccgcucauucucccauaguuugccuauacuugugguaaaugacaagguguuagaggcuaaaucaaaccauacucauacauugaaagauuucauccaugcaauaucugagaaucuucuaccagugaauucaaagaacauuacuaagcuggccaccccaguccacuucaucccagccuuuaaaagucauaaugugcuaacauauagcaaggcacauauagacaugauucuaaaguaggacagagagaagaauguaggggaauuagucagucuuccauuggccuucucucagaaugcuauugaucucaagugaccaaauugaugucuguauagauagcaagugagguuagguggagggagauuauuuccuucauucuaugaggcccugguaaugacaaaugguugagugucacccuaaugcccuggcugcuugggauaugagaaauaguaucuaggaccucguuaaaaaguccauuuauaugaaaaaaaguacauucauccaucuaucuguccaucaucuauccaucuaguuagaccuacuucaaucuauuaaucugguauauauguauguaugcauguauguaucuuuugaucaauugauccaucuaccaagcaucacuguccuucuguucucuauuaccuuuccauacauugacccaauaauccauucaucuauucguggaguauaacgguuagaaaaaugggcgguggaaguagaaaucuacacgaauucucuacggguuguaucaucaccggcagguucacuauuuccuuuagaccucagcuugcccauuuuuaagauggggcugauauuuuacccuaucaaauagagcaaauauaaggauuagaugaguuuagugcuuagaacaaugccagcaucauuaccugccaucuuaauaaaucauaauuuagcaucuauugugacgguugccuugaaggguuuccaugauaguuacgaaagggaagagagagugccaggaguuaauaucauaucacuguucucagaagaaguacccacacuuccuagaauagaggugauuuucgugauaggaguaccagguuaggaagcauacaucugagauagagauaaaaguuccugauguauacaguguggguuagagaauccacugaggcuaaaagauauccacagaaugucuuccuucuguuccaccaaggguuucucuucagacacagggcaggugugggauacaaaggcucugccuuccccagagucuacgugcucaguaggugauaacaagaagauagagagugaaaugagccucaaaaagcaguaagucagauccaguuaggucuuagugccggaaccagguuuagugauuguagaugcuacugguguccugcuguaccuuguagaagagggagaagagguuaguagggguucuacucuccagcaagguccccagcuugcagcacuugcuucuguggaaacugaucauguaucgagcugccagaugugggaaucucagaaacagcucugagccaaggcuuucuaucagaaggaccuagauguauguucaauggagucauugaauugaucuguaaauaauuaaacaguaacagugccaggcacugggcagacagggcaguacuacaggauccuugaauauggauucuggcauuagauaugaacuuaaauccaggcacuaccauaaucuaucugagugucguuggcaaauuaggaucaugucccugccuugugugugcuguuucaaguaaccacucucucuugcaccagauuaaauaguggaggaaaaguuggucuuucaugguauagugucaagggauaaagcugugcugcuuuaaggggcaaagaaggaccugugauuugucuuuguccauugauaccucugcauggcauguaugccaagauuggguuccaaguugacugccaguggccugagagagagagggggagggagggaaggagagagagagagagagagagagagagagagagagagagagagguguagaggugagacacuagucuaucuguucaaucuugucaugcugauggcaagaaaauguucaguuaaccaacuuuggcaaacagagucacccagaaggcguguucaaacagagucucaaucauaagccagagaauucugcucugcagaugucagguucacauuucuauagcaagcccaugugcugcuggggcugcuggggcugcuggggcugcuggggcugcuggggcugcuggggcugcuggggcugcuggggcugcuggggcugcuggggcugcugauugcaauuugagaucagaggcuuacucaugaccaaccaauacucaaggccacgugcagcugaggauagcuuuugucuuuguaacucaauggcaaguccuguuacaauguugagagguugccuucaccugggaccaauuccuaggaugaggaugagcucaugggcaacaggggcucccugugcugaaggauaauuauaccuauggagcugagaggaagggguuggggggagggagggagggagggagggagggagggagagauagaugcugggcagaucauuaagcucacauguuacaguuaugaguguuacauuuuacaaggcucauccauaaaagugcuuggugcuuaguaugccccugguaaauguagcucuuauuuugccaaagcacauagauccguuccauuuacauucugaaaaugcuccgaaguacugucaguugcugucucagcuggcuucucaucaaauaggacaggugagguaaacagcagacacuccaggcacucagugcugcuguugagagucacugaggaaggacacaggggagggagacagacaaucuagggaggcuuccuggaggagguggggacaagagcaaacaguggcuucccagcccuggcaucuugcagagcagugucccuccuauuccccagugucucucugcaaccuucuuuugaccuugccuccuucugccacccucccauguuucugaguugguuuucugguucucugagcugcagagcgauggaaggcgugacagucugugguccauuccuguuuccagguuuauuuggcggacagugacaccacgugacaagcccacaggucccuugcugguggccacauucuggccugagcucccagaaaagauugacgcuguguaugaggccccacaggaggagaaggcuguguucuucgcagguauguaggagggucucgcuggcccucaguuucuguuuaacuggauccacuucuccaccaaaccacaguucucaggcaccugcagguacugcagcuccauuagggaccugccucaacaucacuccccaaagcacagugucuuuguuaggguuucuguuguguuaaaacaccagguucaaaaguaacucgaggaagcaagggcuuaauucagccuacaguuguacgcaggaacccaaggcaggaacugaagcagaagccauagaugagcucugaacacuggcuugcuccccacugcuuacucagccugcuuucuuaugcacuccaggaccaucugcucagaaguggcaucacccacagugggcuggcgccucccacauugaucacugauuaagaaaauggcccacagguuugccuagaggccaauuuuauugaggcauuuuauuuuugcaauugagucccccuucucagauaacucuagcuucugucaaguugacaaaaggaaaaaaaaaaccuagccaacacaccuuagauuuaucuagcauauuuuauuucugcuaggcacccagcauccaccagccucaccccuaggacaaacauuuccucuccucugggcucuuuguugaucuuuguuuccuuuccucuaagaaaauagaaguuccuuucagugcugauauuucccuaacaacuuuccagggcuagaggcuuagucaguagcuaccuuaguuagaccuuuaagugugugugugugugugugugugugugugugugugugugugugugugugugcaugugugucugucucucucugucucuguuucuguauguaugcguauguguauaugucugaguaugugagucucuuucucugucucucucuguuucucuuucucucuucauaucacugucucucucugucucugucucucucugugugugcaugcauguauguuuguguguguauguguguugggguguggccaugagugaagguguucacagaggcuagaggcauugauucccccuggaacuggaguuacaggcaugucuuaggguuuuuauagcuuugauaaagcaccauggcugaaaguaccuuaggaaaggaaggguauauuugaucuuauaucccaccauccagggaagucagggcaggaacucaaggcaaguaccuggaggcagagguuguaagccacccacauggguaacuuggaaucuaacuccagucuuuaagaauaggaagcagucacagucacaccauuucuucagcccccagcggugggugccucaaguuuaacauaaaauguuuuguuuaaacauguaucgguuugaauagagcguggugucugaaaccuggauacaaacaaacuuuuauacaaggugucuagaauccaaagacgcauaaccuggcgucuagaucccaaagaagcaccacuuuaugaggcuuguuacuucuaucuuuguuuucagacaggguuuuaucagacaacucaggcuggccuuugcauuugcuguguagcccaggcuggccuugaaggcucagcuaacuuacugucucauauacaggcagcuuucaucuccauccuuuggugaccauagguucuggccaagugagcuuuggcucucagggcacuuuguccaagugggaaagaggggcuucuugugguugcuaugacaugugcauuggcugcuuaucuuccacaucgccucccuugacugucaccuuuuaccaccaacuuguaaaacccugugcacaugaguuggggaugcaacucaguugguagaauacuugccuaacaugcacaaagcccugggcuucgguucucagcccuauagaagucaggggugggggagucugccucccuguaaucccucaggagaaugagguagggaugaugagauguucgaggccagccuggguuacaugagcucaucucaaaagaaagugaaauaaaacgugauccugugcucgaggccugccucuagggucaaagcugggaucugagcagaaggucacacccgguugagaaagaccaagcaggcucuucugucagagagaugacaggagggccagguuggccggagguauuucccgacagccaccagcucaucuucugucccuucccucagggaaugaguacugggucuauucugcuaguacucuggagcgaggauaccccaagccacugaccagccugggguugcccccugauguccagcaaguagaugcugccuuuaacuggaguaagaacaagaagacauacaucuuugcaggagacaaguucuggagguaagggggucccagguacaauggcgacauggcuaguuucaugcggaaagacacuauguggcuugauauacacaguguggguagaugucuccucccugguucccagccugccagggaagaggcccuccaaggggagucaggaugcacuuucuuuguaauauuguuaggguaaugcuugccuaaguuuccuuuccuuuuucagcugucucugauugggcauaaagacaucuagucuagagcccccuguuagggcaauguagaagagcugguaacacaguuagagagacuaguggcuauuguugcugguauaugccagaugcuaauuggaaggcccaguguaguacaagucacaguucuuccaacuuuucaccggcaggaaacaguugcaagggguuaaaaacuagcuucaguuccuacagagccauggagugacaacugggcuuugaguccuggcauucuggcccuggagagugucuuuguccuccaaugcccuagaaaccgagggagggaaguugaagguaagggagcagagggaaaugaggaagacagcauccaaccaggcccugggaagccacagacagccucccccaugucugcagcaggcacacucccucuugacugcaggcaucccccacaucacgucaguagcaggcacccuccccuaugucugcagcaagucuggccaguggugcagacuggcagggggagcaguuuacaagcagguggcucuguuccaaguccucugaaaagaaggcucuagcacugagaggcaaaggugaggaugaggggccagagaaagcaguauccauagacauagcuuaaacccacgaguaugcuuacaauccuucacagcuuagcggucaggaaacugagaccuaaagaaacuaacgaacucagucgucccacuuacauguaagugugcuggcccggagauacgccuaaagaugcuuuuccucugucuuccccagugucgccuucacugugccuucugggucauuugaucagugaguggacuagaguucuauagcaccccuccaucucccccaucccacguucuguggcugucauuguauucaagccuuucccaggaacuaguaauggaacucccacacuuggucuggcgucccugaacaaacaauccugcuuccuucauggccucugucuccucccccuucucuuccccucaccccaccagcaacuggccugauucagaagcugcuuaugucccggggcugcccauggcaggguggaauucuggacgcacugcugagauacuuagcaaccuaagcugauugguaucucaagccucaagaagaaaaacagucugucaggaaaccacugagcugaccucggcacaugggcuccggaacacccccggcaugcccacguacugcgaauggcaucccaggcacucugaaucuuucaaaccgaguguggaaggagggagagauggagagucacagacaagugauucgggaaucucagaauccuauaaacccuaggugauuugucugcaaugucugggaaguacucccacagaaccccuccuacacacccuaugugcauauacaugcaagaacaggcaugucccaugugagcaggggugugcauacauacacagacucacaggcccugaaaugucuuccugguuucuuuucaucuuuuuccuugauaaggccucuaauucuagaugcuagaacagauacuguccucugcugagggugcuccaugagccuuugauaaaggggccagacuagaaagggcugaucucagacaggucugucccaggaaaggugacacagaguuugagauacuuucaugggccaugguuguaggggagagagagagagggaaagggggugggaggggggagagggagagacagacagagacagacagagacagacagagacuagggugaucaguuggcuccagcaggccagcugcugcuuuuugaaguccccacugaaaccacagauaagcauucagugucccuuaugugcuuuguauagaauuaggugcuggugaugagcucugauguagcuccucauugucuuccuggagcuuauggugcaaagaggcucaaaaacguuugcaugguuaccaaaccugagucuuacuccagauagaagcucugcauauccuguggauugauuucucauuuaauguagauauuguuaugagcaccauuuucuggaccaaggguacaaaagcggaaguaugucaaagacacccguggaaaaccuaggacacaaaugccucuucugacucuccguuucacccucuacaucuguagacagucauucaagaugacacuugagagacagggaggaagggacaccucuccugacauggcacggcacuguagucuuccuggaugaaaagaacuuucuggaagcaagcugguucauuucucugacccucaccuauacaguggguggggguugauuccugcccucucuuugugcuagggggaauccuuggggcuuggggcacacaucucuguaacauuguaauuucagggauuuacaguggggggcucaguagaggucauguagaugggggguggggauggggauuuugagcuagguuuuggcaacuugggcccugaagaaacagcuuuuccaagaaauuguuauucagaugaagcuacaguugugaagguuuuucugacaguucauggggugauggguugcaagggaacccccuagaaaagacagaugugggauaggcuuugguuggugccccugacugaggugguagggcugcuucuagggaaaaggagguccauccaggaugcuguguggaggaaagaaagcuuggccaucccuagaaugguaccuaaaaggaucugcuuagaaauuucugccuuggaggugagguuugaccuuguuuacugagauagccacaggcacacaguggggggcgcauuagcuuguauaguguuaccucuuuauaauaaauauagcuaguauguugggaggaagacagagggaaagagaagagaggaaaaggaaagcagcaauuuaaaagugcuccaagaaacuugaaacaacagcaaggagaaggauuuccuaacgcuuaagguguuuaccuggauuaaauucagggccugguagaacauguacccugacagcucuggcugggacugcauagcauucagucugcccggugacucacggccuugagcuuacacccaccacauggcauuguaaccucacucucucugagccucgguuaacucccagacauggcuugugauccccgcuugacagaugaagaagcagcaauuuguucaaaccacacaauggaagaauuaugggucugguucacugguccuaggacugcagcagggagucaaagguugccagggaggggcuugagacguggcucagcacucaacagcacuaucugcuguucuccaagugcuggguuuaauucccagcacccauacgguucauaaccaucucuaguucucggggaucugacucccucauuuggcuuuugaggacacuuacucacaugacacacagacauacaugcaggcaaaacacccaaacauaugacaaauuaaaugaaaaaaaauggccuuaaaagaaugaucacuucccuaauccugcugaauaccagacaugggagaaaugcaagcuugugcuucuugguggcagucacacuggcuguugcuuuuagggauugucucaagccauucaauuaggagguaguggugagggauccagacccaggucugacccucacauugcuucuuacuuccccuuugaagggccacgucuuauucccuggacccauucugugccaucggugaagggggugggcaggggauuggccuccacagaagccaucuaugucacccugucucuuuccuagauacaaugaagugaagaagaaaauggaccccgguuucccuaagcucaucgcagacuccuggaaugccaucccugauaaccuggaugccgucguggaccugcagggugguggugagcuacccaggccucuguuagcguuccaggauugccugacccgagccagaaaacagcuccucuuuggcacacacuccugcagggcagucccagaaaacaagccagucccuucagcucagugcugggaaggcagccaguccccugacccuugcuggcccggccaagcuccaggcuguaagaccuagaaaggcccuuacagcugcagagccuggagccccagaagggaagggcugggaggccuccagggaccaggaauauggccuggugcccuaaauucauucuggggguugagccaggcuguauuggguuucucaggaggccuuuuaagcaccucccaucagaagcagggcucuacucaagacaaggcaaacuuugucaugcucugucacuccugcggcagugacccccacuccgcugcuugcuucuuugcagcaucagcacaggacaguaauuggaauuugaaaaccauauucccagggaggcuucugugacucucuaggauccuggaaaugaacucaguuuggcuuucauggcuuauuagaggagauuuuaauucagcaccacaaaggugugugugugugugugugugugugugugugugugugugugugugugugugugugguguggguguggaugcucuuaccaucugcaaagcucauaucccugagcuuccaugggaagugaagaaagaaagccauguauaaucaggugcuccauuaaggauugcugucaaagucccuacugugagcuaggguuuuaaacggaguagacagggucauucauguuuggaggaauucacacauuccagagccucuagagaccaggagggaaaacaguagaaaagaaauaugcauauguguguguguuuggguggguguguauaugugaguaagugugugugugugugugugugugagugugcaugcuucugugcaugugucugagugugggucugacuaugugcacacauguaaaugugcacuauugagugcaugaauuuguacauguguguaaguaugaguguggaccucaguguguguguauguguguguguguuggugaguauaugaguauacguguggguguguguauauaugugugugccuauuuaugagugugcauguguagaucugaauguuugugugugcauguguauggaccugaguguguguguuuguguguauguguacuugagugugcaugugggcuaaguguguggggcacuguguaugugugugagaguuuguguguauauguggcuaagugagugugagugugugggugggucugugugaguguauuuguggggggcugaguguaugugagaguuuguguguaugccugagugugugugugugugugugugugugugugugugcuugagugugugugugugcuugugugugugugagggcugaauaugugcucacggagggacgugauuguugugugacugugugugagugugugggaagucugagagagagagagagagaguuuuauaagaaaccagaggcaagugauucacugacagcgaagggucauuccucagccucugcugacugcugaccugaaagaguagggucugguggguuuauuuauuuuagagguuuaaagagaagccagacauccgcauuuucauaugcuauugccagauguguugacaucuuggcaacucauucagaauuaaagacaaagagaagcaaauauuuauguuuagauucauauucauauuuacauuuauuuauauuuauacuuaaauaugggccuucugcuccccaucccaugauauaugauauauguguuuggcuugugcucagaaaggugcuguugucaccaguagcaaauauugaguaacuuaaucucauaacaaauucuaaguuaguaguuuucaaccugugggucuugaccccucuagggggaucaaaugacccuuucacagggguugccuaagaccauuggaaaaaagauauuuacauuaugauucuaucaguagcaaaguuacacuuauuauguagcaaugaaauaauuuuauggcuggggaggggucaucacaugagaaacuguauuaaaggguaaagacccacaggucaagaaccgcugcucuaagaaguugguacccugaucccuggcuuagagguacagcuacuaagagaccuaacuuccaagccauuccucacauuccucccuuccuccagagggucuucccugguugaaaagcugcuuccccaugccaagcagacuuagcagcucccagggaccuccugcguaucacguaaggucagaguggguccagucucucuucuuucucucucucuuaggucauagcuacuucuucaagggugcuuauuaccugaagcuggagaaccaaagucucaagagcgugaaguuuggaagcaucaaaucagacuggcugggcugcugagcuggcccuguucccacgggcccuaucaucuucaucgcugcacaccaggugaaggaugugaagcagccuggcggcucuguccuccucuguaguuaaccagccuucuccuucaccuggugacuucagauuuaagaggguggcuucuuuuugugcccaaagaaaggugcugacuguacccucccgggugcugcuucuccuuccugcccacccuaggggaugcuuggauauuugcaaugcagcccuccucugggcugcccuggugcuccacucuucugguucuucaacaucuaugaccuuuuuauggcuuucagcacucucagaguuaauagagacuggcuuaggagggcacugguggcccuguuaacagccuggcauggggcagugggguacaggugugccaagguggaaaucagagacaccugguuucacccuuucugcugcccagacaccugcaccaccuuaacuguugcuuuuguaugcccuucgcucguuuccuucaaccuuuucaguuuuccacuccacugcauuuccugcccaaaggacucggguugucugacaucgcugcaugaugcaucucagcccgccuagugaugguuccccuccucacucugugcagaucaugcccagucacuuccuccacuggauggaggagaaccaagucaguggcuuccugcucagccuucuugcuucucccuuuaacaguuccccaugggaaauggcaaacaaguauaaauaaagacacccauugagugaca

SEQ ID NO: 12151 - RNA, 26094 nt, Mus musculus
ugucacucaaugggugucuuuauuuauacuuguuugccauuucccauggggaacuguuaaagggagaagcaagaaggcugagcaggaagccacugacuugguucuccuccauccaguggaggaagugacugggcaugaucugcacagagugaggaggggaaccaucacuaggcgggcugagaugcaucaugcagcgaugucagacaacccgaguccuuugggcaggaaaugcaguggaguggaaaacugaaaagguugaaggaaacgagcgaagggcauacaaaagcaacaguuaagguggugcaggugucugggcagcagaaagggugaaaccaggugucucugauuuccaccuuggcacaccuguaccccacugccccaugccaggcuguuaacagggccaccagugcccuccuaagccagucucuauuaacucugagagugcugaaagccauaaaaaggucauagauguugaagaaccagaagaguggagcaccagggcagcccagaggagggcugcauugcaaauauccaagcauccccuagggugggcaggaaggagaagcagcacccgggaggguacagucagcaccuuucuuugggcacaaaaagaagccacccucuuaaaucugaagucaccaggugaaggagaaggcugguuaacuacagaggaggacagagccgccaggcugcuucacauccuucaccuggugugcagcgaugaagaugauagggcccgugggaacagggccagcucagcagcccagccagucugauuugaugcuuccaaacuucacgcucuugagacuuugguucuccagcuucagguaauaagcacccuugaagaaguagcuaugaccuaagagagagagaaagaagagagacuggacccacucugaccuuacgugauacgcaggaggucccugggagcugcuaagucugcuuggcauggggaagcagcuuuucaaccagggaagacccucuggaggaagggaggaaugugaggaauggcuuggaaguuaggucucuuaguagcuguaccucuaagccagggaucaggguaccaacuucuuagagcagcgguucuugaccugugggucuuuacccuuuaauacaguuucucaugugaugaccccuccccagccauaaaauuauuucauugcuacauaauaaguguaacuuugcuacugauagaaucauaauguaaauaucuuuuuuccaauggucuuaggcaaccccugugaaagggucauuugaucccccuagaggggucaagacccacagguugaaaacuacuaacuuagaauuuguuaugagauuaaguuacucaauauuugcuacuggugacaacagcaccuuucugagcacaagccaaacacauauaucauauaucaugggauggggagcagaaggcccauauuuaaguauaaauauaaauaaauguaaauaugaauaugaaucuaaacauaaauauuugcuucucuuugucuuuaauucugaaugaguugccaagaugucaacacaucuggcaauagcauaugaaaaugcggaugucuggcuucucuuuaaaccucuaaaauaaauaaacccaccagacccuacucuuucaggucagcagucagcagaggcugaggaaugacccuucgcugucagugaaucacuugccucugguuucuuauaaaacucucucucucucucucucagacuucccacacacucacacacagucacacaacaaucacgucccuccgugagcacauauucagcccucacacacacacaagcacacacacacacucaagcacacacacacacacacacacacacacacacacucaggcauacacacaaacucucacauacacucagccccccacaaauacacucacacagacccacccacacacucacacucacuuagccacauauacacacaaacucucacacacauacacagugccccacacacuuagcccacaugcacacucaaguacacauacacacaaacacacacacucagguccauacacaugcacacacaaacauucagaucuacacaugcacacucauaaauaggcacacacauauauacacacacccacacguauacucauauacucaccaacacacacacacauacacacacacugagguccacacucauacuuacacacauguacaaauucaugcacucaauagugcacauuuacaugugugcacauagucagacccacacucagacacaugcacagaagcaugcacacucacacacacacacacacacacacuuacucacauauacacacccacccaaacacacacacauaugcauauuucuuuucuacuguuuucccuccuggucucuagaggcucuggaaugugugaauuccuccaaacaugaaugacccugucuacuccguuuaaaacccuagcucacaguagggacuuugacagcaauccuuaauggagcaccugauuauacauggcuuucuuucuucacuucccauggaagcucagggauaugagcuuugcagaugguaagagcauccacacccacaccacacacacacacacacacacacacacacacacacacacacacacacacacacaccuuuguggugcugaauuaaaaucuccucuaauaagccaugaaagccaaacugaguucauuuccaggauccuagagagucacagaagccucccugggaauaugguuuucaaauuccaauuacuguccugugcugaugcugcaaagaagcaagcagcggagugggggucacugccgcaggagugacagagcaugacaaaguuugccuugucuugaguagagcccugcuucugaugggaggugcuuaaaaggccuccugagaaacccaauacagccuggcucaacccccagaaugaauuuagggcaccaggccauauuccuggucccuggaggccucccagcccuucccuucuggggcuccaggcucugcagcuguaagggccuuucuaggucuuacagccuggagcuuggccgggccagcaagggucaggggacuggcugccuucccagcacugagcugaagggacuggcuuguuuucugggacugcccugcaggagugugugccaaagaggagcuguuuucuggcucgggucaggcaauccuggaacgcuaacagaggccuggguagcucaccaccacccugcagguccacgacggcauccagguuaucagggauggcauuccaggagucugcgaugagcuuagggaaaccgggguccauuuucuucuucacuucauuguaucuaggaaagagacagggugacauagauggcuucuguggaggccaauccccugcccacccccuucaccgauggcacagaauggguccagggaauaagacguggcccuucaaaggggaaguaagaagcaaugugagggucagaccugggucuggaucccucaccacuaccuccuaauugaauggcuugagacaaucccuaaaagcaacagccagugugacugccaccaagaagcacaagcuugcauuucucccaugucugguauucagcaggauuagggaagugaucauucuuuuaaggccauuuuuuuucauuuaauuugucauauguuuggguguuuugccugcauguaugucugugugucaugugaguaaguguccucaaaagccaaaugagggagucagauccccgagaacuagagaugguuaugaaccguaugggugcugggaauuaaacccagcacuuggagaacagcagauagugcuguugagugcugagccacgucucaagccccucccuggcaaccuuugacucccugcugcaguccuaggaccagugaaccagacccauaauucuuccauugugugguuugaacaaauugcugcuucuucaucugucaagcggggaucacaagccaugucugggaguuaaccgaggcucagagagagugagguuacaaugccaugugguggguguaagcucaaggccgugagucaccgggcagacugaaugcuaugcagucccagccagagcugucaggguacauguucuaccaggcccugaauuuaauccagguaaacaccuuaagcguuaggaaauccuucuccuugcuguuguuucaaguuucuuggagcacuuuuaaauugcugcuuuccuuuuccucucuucucuuucccucugucuuccucccaacauacuagcuauauuuauuauaaagagguaacacuauacaagcuaaugcgccccccacugugugccuguggcuaucucaguaaacaaggucaaaccucaccuccaaggcagaaauuucuaagcagauccuuuuagguaccauucuagggauggccaagcuuucuuuccuccacacagcauccuggauggaccuccuuuucccuagaagcagcccuaccaccucagucaggggcaccaaccaaagccuaucccacaucugucuuuucuaggggguucccuugcaacccaucaccccaugaacugucagaaaaaccuucacaacuguagcuucaucugaauaacaauuucuuggaaaagcuguuucuucagggcccaaguugccaaaaccuagcucaaaauccccauccccaccccccaucuacaugaccucuacugagccccccacuguaaaucccugaaauuacaauguuacagagaugugugccccaagccccaaggauucccccuagcacaaagagagggcaggaaucaacccccacccacuguauaggugagggucagagaaaugaaccagcuugcuuccagaaaguucuuuucauccaggaagacuacagugccgugccaugucaggagaggugucccuuccucccugucucucaagugucaucuugaaugacugucuacagauguagagggugaaacggagagucagaagaggcauuuguguccuagguuuuccacgggugucuuugacauacuuccgcuuuuguacccuugguccagaaaauggugcucauaacaauaucuacauuaaaugagaaaucaauccacaggauaugcagagcuucuaucuggaguaagacucagguuugguaaccaugcaaacguuuuugagccucuuugcaccauaagcuccaggaagacaaugaggagcuacaucagagcucaucaccagcaccuaauucuauacaaagcacauaagggacacugaaugcuuaucugugguuucaguggggacuucaaaaagcagcagcuggccugcuggagccaacugaucacccuagucucugucugucucugucugucucugucugucucucccucuccccccucccacccccuuucccucucucucucuccccuacaaccauggcccaugaaaguaucucaaacucugugucaccuuuccugggacagaccugucugagaucagcccuuucuagucuggccccuuuaucaaaggcucauggagcacccucagcagaggacaguaucuguucuagcaucuagaauuagaggccuuaucaaggaaaaagaugaaaagaaaccaggaagacauuucagggccugugagucuguguauguaugcacaccccugcucacaugggacaugccuguucuugcauguauaugcacauaggguguguaggagggguucugugggaguacuucccagacauugcagacaaaucaccuaggguuuauaggauucugagauucccgaaucacuugucugugacucuccaucucucccuccuuccacacucgguuugaaagauucagagugccugggaugccauucgcaguacgugggcaugccggggguguuccggagcccaugugccgaggucagcucagugguuuccugacagacuguuuuucuucuugaggcuugagauaccaaucagcuuagguugcuaaguaucucagcagugcguccagaauuccacccugccaugggcagccccgggacauaagcagcuucugaaucaggccaguugcugguggggugaggggaagagaagggggaggagacagaggccaugaaggaagcaggauuguuuguucagggacgccagaccaagugugggaguuccauuacuaguuccugggaaaggcuugaauacaaugacagccacagaacgugggaugggggagauggaggggugcuauagaacucuaguccacucacugaucaaaugacccagaaggcacagugaaggcgacacuggggaagacagaggaaaagcaucuuuaggcguaucuccgggccagcacacuuacauguaagugggacgacugaguucguuaguuucuuuaggucucaguuuccugaccgcuaagcugugaaggauuguaagcauacucguggguuuaagcuaugucuauggauacugcuuucucuggccccucauccucaccuuugccucucagugcuagagccuucuuuucagaggacuuggaacagagccaccugcuuguaaacugcucccccugccagucugcaccacuggccagacuugcugcagacauaggggagggugccugcuacugacgugaugugggggaugccugcagucaagagggagugugccugcugcagacaugggggaggcugucuguggcuucccagggccugguuggaugcugucuuccucauuucccucugcucccuuaccuucaacuucccucccucgguuucuagggcauuggaggacaaagacacucuccagggccagaaugccaggacucaaagcccaguugucacuccauggcucuguaggaacugaagcuaguuuuuaaccccuugcaacuguuuccugccggugaaaaguuggaagaacugugacuuguacuacacugggccuuccaauuagcaucuggcauauaccagcaacaauagccacuagucucucuaacuguguuaccagcucuucuacauugcccuaacagggggcucuagacuagaugucuuuaugcccaaucagagacagcugaaaaaggaaaggaaacuuaggcaagcauuacccuaacaauauuacaaagaaagugcauccugacuccccuuggagggccucuucccuggcaggcugggaaccagggaggagacaucuacccacacuguguauaucaagccacauagugucuuuccgcaugaaacuagccaugucgccauuguaccugggacccccuuaccuccagaacuugucuccugcaaagauguaugucuucuuguucuuacuccaguuaaaggcagcaucuacuugcuggacaucagggggcaaccccaggcuggucaguggcuugggguauccucgcuccagaguacuagcagaauagacccaguacucauucccugagggaagggacagaagaugagcugguggcugucgggaaauaccuccggccaaccuggcccuccugucaucucucugacagaagagccugcuuggucuuucucaaccgggugugaccuucugcucagaucccagcuuugacccuagaggcaggccucgagcacaggaucacguuuuauuucacuuucuuuugagaugagcucauguaacccaggcuggccucgaacaucucaucaucccuaccucauucuccugagggauuacagggaggcagacucccccaccccugacuucuauagggcugagaaccgaagcccagggcuuugugcauguuaggcaaguauucuaccaacugaguugcauccccaacucaugugcacaggguuuuacaaguuggugguaaaaggugacagucaagggaggcgauguggaagauaagcagccaaugcacaugucauagcaaccacaagaagccccucuuucccacuuggacaaagugcccugagagccaaagcucacuuggccagaaccuauggucaccaaaggauggagaugaaagcugccuguauaugagacaguaaguuagcugagccuucaaggccagccugggcuacacagcaaaugcaaaggccagccugaguugucugauaaaacccugucugaaaacaaagauagaaguaacaagccucauaaaguggugcuucuuugggaucuagacgccagguuaugcgucuuuggauucuagacaccuuguauaaaaguuuguuuguauccagguuucagacaccacgcucuauucaaaccgauacauguuuaaacaaaacauuuuauguuaaacuugaggcacccaccgcugggggcugaagaaauggugugacugugacugcuuccuauucuuaaagacuggaguuagauuccaaguuacccauguggguggcuuacaaccucugccuccagguacuugccuugaguuccugcccugacuucccuggauggugggauauaagaucaaauauacccuuccuuuccuaagguacuuucagccauggugcuuuaucaaagcuauaaaaacccuaagacaugccuguaacuccaguuccagggggaaucaaugccucuagccucugugaacaccuucacucauggccacaccccaacacacauacacacacaaacauacaugcaugcacacacagagagagacagagacagagagagacagugauaugaagagagaaagagaaacagagagagacagagaaagagacucacauacucagacauauacacauacgcauacauacagaaacagagacagagagagacagacacacaugcacacacacacacacacacacacacacacacacacacacacacacacacacuuaaaggucuaacuaagguagcuacugacuaagccucuagcccuggaaaguuguuagggaaauaucagcacugaaaggaacuucuauuuucuuagaggaaaggaaacaaagaucaacaaagagcccagaggagaggaaauguuuguccuaggggugaggcugguggaugcugggugccuagcagaaauaaaauaugcuagauaaaucuaagguguguuggcuagguuuuuuuuuuccuuuugucaacuugacagaagcuagaguuaucugagaagggggacucaauugcaaaaauaaaaugccucaauaaaauuggccucuaggcaaaccugugggccauuuucuuaaucagugaucaaugugggaggcgccagcccacugugggugaugccacuucugagcagaugguccuggagugcauaagaaagcaggcugaguaagcaguggggagcaagccaguguucagagcucaucuauggcuucugcuucaguuccugccuuggguuccugcguacaacuguaggcugaauuaagcccuugcuuccucgaguuacuuuugaaccugguguuuuaacacaacagaaacccuaacaaagacacugugcuuuggggagugauguugaggcaggucccuaauggagcugcaguaccugcaggugccugagaacugugguuugguggagaaguggauccaguuaaacagaaacugagggccagcgagacccuccuacauaccugcgaagaacacagccuucuccuccuguggggccucauacacagcgucaaucuuuucugggagcucaggccagaauguggccaccagcaagggaccugugggcuugucacguggugucacuguccgccaaauaaaccuggaaacaggaauggaccacagacugucacgccuuccaucgcucugcagcucagagaaccagaaaaccaacucagaaacaugggaggguggcagaaggaggcaaggucaaaagaagguugcagagagacacuggggaauaggagggacacugcucugcaagaugccagggcugggaagccacuguuugcucuuguccccaccuccuccaggaagccucccuagauugucugucucccuccccuguguccuuccucagugacucucaacagcagcacugagugccuggagugucugcuguuuaccucaccuguccuauuugaugagaagccagcugagacagcaacugacaguacuucggagcauuuucagaauguaaauggaacggaucuaugugcuuuggcaaaauaagagcuacauuuaccaggggcauacuaagcaccaagcacuuuuauggaugagccuuguaaaauguaacacucauaacuguaacaugugagcuuaaugaucugcccagcaucuaucucucccucccucccucccucccucccucccuccccccaaccccuuccucucagcuccauagguauaauuauccuucagcacagggagccccuguugcccaugagcucauccucauccuaggaauuggucccaggugaaggcaaccucucaacauuguaacaggacuugccauugaguuacaaagacaaaagcuauccucagcugcacguggccuugaguauugguuggucaugaguaagccucugaucucaaauugcaaucagcagccccagcagccccagcagccccagcagccccagcagccccagcagccccagcagccccagcagccccagcagccccagcagccccagcagcacaugggcuugcuauagaaaugugaaccugacaucugcagagcagaauucucuggcuuaugauugagacucuguuugaacacgccuucugggugacucuguuugccaaaguugguuaacugaacauuuucuugccaucagcaugacaagauugaacagauagacuagugucucaccucuacaccucucucucucucucucucucucucucucucucucucucucuccuucccucccucccccucucucucucaggccacuggcagucaacuuggaacccaaucuuggcauacaugccaugcagagguaucaauggacaaagacaaaucacagguccuucuuugccccuuaaagcagcacagcuuuaucccuugacacuauaccaugaaagaccaacuuuuccuccacuauuuaaucuggugcaagagagagugguuacuugaaacagcacacacaaggcagggacaugauccuaauuugccaacgacacucagauagauuaugguagugccuggauuuaaguucauaucuaaugccagaauccauauucaaggauccuguaguacugcccugucugcccagugccuggcacuguuacuguuuaauuauuuacagaucaauucaaugacuccauugaacauacaucuagguccuucugauagaaagccuuggcucagagcuguuucugagauucccacaucuggcagcucgauacaugaucaguuuccacagaagcaagugcugcaagcuggggaccuugcuggagaguagaaccccuacuaaccucuucucccucuucuacaagguacagcaggacaccaguagcaucuacaaucacuaaaccugguuccggcacuaagaccuaacuggaucugacuuacugcuuuuugaggcucauuucacucucuaucuucuuguuaucaccuacugagcacguagacucuggggaaggcagagccuuuguaucccacaccugcccugugucugaagagaaacccuugguggaacagaaggaagacauucuguggauaucuuuuagccucaguggauucucuaacccacacuguauacaucaggaacuuuuaucucuaucucagauguaugcuuccuaaccugguacuccuaucacgaaaaucaccucuauucuaggaaguguggguacuucuucugagaacagugauaugauauuaacuccuggcacucucucuucccuuucguaacuaucauggaaacccuucaaggcaaccgucacaauagaugcuaaauuaugauuuauuaagauggcagguaaugaugcuggcauuguucuaagcacuaaacucaucuaauccuuauauuugcucuauuugauaggguaaaauaucagccccaucuuaaaaaugggcaagcugaggucuaaaggaaauagugaaccugccggugaugauacaacccguagagaauucguguagauuucuacuuccaccgcccauuuuucuaaccguuauacuccacgaauagaugaauggauuauugggucaauguauggaaagguaauagagaacagaaggacagugaugcuugguagauggaucaauugaucaaaagauacauacaugcauacauacauauauaccagauuaauagauugaaguaggucuaacuagauggauagaugauggacagauagauggaugaauguacuuuuuuucauauaaauggacuuuuuaacgagguccuagauacuauuucucauaucccaagcagccagggcauuagggugacacucaaccauuugucauuaccagggccucauagaaugaaggaaauaaucucccuccaccuaaccucacuugcuaucuauacagacaucaauuuggucacuugagaucaauagcauucugagagaaggccaauggaagacugacuaauuccccuacauucuucucucuguccuacuuuagaaucaugucuauaugugccuugcuauauguuagcacauuaugacuuuuaaaggcugggaugaaguggacugggguggccagcuuaguaauguucuuugaauucacugguagaagauucucagauauugcauggaugaaaucuuucaauguaugaguaugguuugauuuagccucuaacaccuugucauuuaccacaaguauaggcaaacuaugggagaaugagcggcauguagaauauaucagaccugcugauucaaaggcuuagauaucugguugacccagaauucaagagagccacuugaauuguaagcuaccaagagcuguggguugugagacacaagcaaaaacugcuuacugcaggucauucugugaggcuccaggagcccuccacaacagugggggcacaagaacaaugggaaaggacagagguuagaggguaagaaagacaaaagcaaccucacucaccgguccuugaagaagaagaucucaccacggaucugagcgaugccaucaaagacaauguccuguuugcagaucuccggagugacaggucccaguguugguguggggccaguaccagugucaguaucagcaucgggggagggcccuagggaauggggagacaccugacccuagacucuacccagcaacaaggcuucucaucgccaggcucaaccccuguacuacucacuuaacuggcuaaggcuacaaaaaaaaaagagcagucuaccuggguagagccugagcuuagagaagggaccagacgcuugacucuuguguggucucuuacuuuaagaacagagaaggcuggcuggugccaguagagguguggcacuuucuuaaggauuugcuuuuguacuccucaggcugcgcaacaguggagucuagggaggcgaacaguugcaucauuccagcuggcauguagccuuagcgggacugcaaugucacccaucaaugucugcaucucugauucuuucccaaguucagaguccgugagcuuccccauccagguuucacuuucaccacgcgcuugguccaggaaccacuaggacuauuauauaauugauuucuuuuuuuaagaaauugacuggcugcuuuuuagccucuaaccucacugaaagcgcagacaauaggccaucauugguggcaggaagcaguuauuauguuucuauggcaaaaugaaacaugagcaucuuacaagaacuaguaacacccauuucacgccagagaaaauucugcccuguaggcagcucccucuucuggauccuaaacccuaccuggcugcugaaaccuaguugauauugggcuaaacgccuuucuuagccucaguucauauaccuagcacauggaaaugggaaccaagagaggcauggauaacuagagucuagaaaggacagagcugucucagaagcccuuuggagcauuacucuaaagccugaggaccaggcacgagccauguccccugaugaugucccuggccauucuaacuagaugaggucuggcauuuuccacuccugcgucuucccacccaggcugugggauccucgaagacaccucuccccucagagucccacaagcugcggcuuaccauagagcuccuggauccccuugaugucaucaugggauaaucggaaguucuugguguagguguagaucggggccaucagagcuccaggguccugagaguguuccagccccauggcauggccgaacucaugggcugccacgaggaauaggcuauauccugagugccaaagcagggacaugagguggaauucaagagagaaauaagacaggcaucaagacuugcuuaauaggaaggagguuugggggaggacaacuccaggguagagcuaaaaguucuagaaguggcacauauugguuuuucccuugugcugagagugcuguugcuuuugaguaggccagucagcauccucuugccuuuucccaaugauggcugcaugugguaugagggcgagagaaaggggcaucugcuucaagucccaucugugaaaaagcaugcuuuuuagcccuuugugagaguugacacaaaaccugcugcucaggaucucaaagaagaagagugagagggagagucuggccucaggguuucaccauuucuucccagggaaggaaguaaaagccacuccccugggaaugcagcuugaugauauaacauucgccuaguguaugccagcaaauccagucccauggggaaacugaaacaaaacauauucaugccuguauggcuugcucaggcuuggccauggagagcaggcaaaucgugugccacacccuccgugcugugacucaauuaucccacaagccccacuacaauaacaauaacaauaacaacaacaacaacaauaauaaugaugaugaugaugauaguauaaaauagaauucugucccugguuaccuaggacaugccaucuuauuugcagacaucaccaaaauggaagccagagccaagaaugauauaucuaacuauaauuccagugcuugacaugcugaaguaggguugugagcuuaagacgaaucugggcugcauagugaaacccugucucaaauagaugaaucaguuaaaaugcuacccucauugcagccaacgagcccuuaacccacuguggauuacaaccucuuaggaagagagacaaagggaccgauagggaccagagagugacauauaauggcugaagcgggcaauaaggugauacaggcauggggguggggguagggggauggggagagacacuuugguuguaaacuuccagccuucugacuaggggaagagucaguuuauguuguccuaagccaccaguauauuaugcuuuguacguggcagccugaguggccacaaacucuucacauggguggagaucucaccauaggcagaaguugcaccaagcaggggugucagacuaucuccuaugauagccuuuggcgggcaagaaaaaauuccuaagaaaaccucauuuggccagcauucaccaaagugcaccucaauacaagagaaaagcaaucaucacagaaggaagagugucccggugagcaucaacucuccaugccacacagccuagagucaucguuaaaacucucaguugacuguugaucuucaucagguuggucuccaggcaugcugccgaggaacucucuuauuauuaauagaugcagagagcauagcuuacugcagcuccguucccuacgcauauacccuaggcuguacaggaaagcaagcuaagcgucagcccgugagcuagcuacauagugcuauccugccaucagccugugagcuaacuacacagugcuauccugccaugguucuugccuccagguucucaccuuaaguucuugcccugacuucccucaaucugggaguguaagccucuuuguagaucuuuccucccuaaguguucauucacaacaacaaaaaucaaucuagaauagaaacccaccuaauucugccagauccuggacccauccccuugccuaaacauuuugggcuaccugaaacacugaaguccugggcaucuaggcagugaagguugcccagcucaaagaccaacaguaaggucuuucaaugacuccugcuagugacaguccugucuggaaggguagcuggagugguagguaagaaaugcaaaagcagggcugauccccacucagggucagugccuagucaucucauuuugaagcuguaugaauguccaccuaaacugucuggaccuaagcagggaaccugucuucccugccggagcagaguuuccucugcucugaaggcuagaucugaagguacaauggggguaucuuguuuagagacaauaucuaugcuugauccaucgucuggaccucagguuguuccaggucagguguggagggguguccagugucucuacccaaaggccagggccucauaccuuggucaggacagaagccccacuuccggucaucaucguaguugguuguggucgcacaccacaccuugccaucguugcggccggcgcuggugcagcucucauacuuguugcccaggaaagugaaggggaagacacauggggcaccuucugaauuuccacccacaguggacauagcugggggguaaaagacagaggucaagaggcagcagaggaucugaggccacagucgggaaccaaugacaagacggugacauuaacaugcacucacuggguacugguccauccuauucaccuccaucaauagcccugucauaggagagacccuauagugacaucuccaugucauagaugggacuugucuugaagaggcucaaagagauuaagaaacuugcuacgcagauaauacuugaaaguuaaguaccagacccaagguuuaaacccagguagccauaguucagagucuagaaauggacccuuguagauaggagcagagaggccagacacccagagggcugagagagcagauggucucaacacacugcccuagaagaugagccuugaggcacacagucuuacaaacgcaaaucucugcuuuagcuucaagaagcaggcucaguaaacacauguuggagaaaagaacagugagaaaggaugaguaagagaugagacauagaagcgaugcagucaagagaaggugaggggaaagauucaaggucagagggagggagauacagugucagagcugaaagacugggugcaaacuggcuagcaggcugugagccagcuggccaggaaucaauagcacaccugcaacagcugacucccacgccuuugugguaccacagcuagucuuggggaagaugcuguagguagccaaguggguauuaaaugucaaaaugcuugccucugaggagcauagagaggcagggauacccaccggucucgggacagaauccauacuucuuaucccggucauaguccucgguggugccacaccagcgguagccaucggugcggcccucggugguacagcuguuguaggaggugcccuggaagcggaacgggaacuugcagggcuguccaucugcauugccacccaugguaaacaaggcuggggaggggaagagagggaaaagaugccauugagagagauaacuggcuggguagacuuggcuagucacccacuugcugguucauuuaagaguaguuguagcuguuaaaaauauuaauuacaaacaaucucuagaggcuggagagauggcucugcaguuacaagcaaugacugcucuuccagaggauccaaguuugggucucagcacucaugucaaauaauucacaaccaucuguaaguccagcuacagggauuugaugcuucuagccucagagguacuuacacucaucuguacauacgcacacaaagacauacacaccuacacuaguuuaaaaugauaaauaaauaaauaaaucuaaaauaccagugaacacugacuucucgagaaaguuucaguauucucuggacaucuccacugaugcuauagccaauccccacagaaaggaggggagaaggagaagggguagcugguaucuuagccuccuacucugaugaccacaggguagggcaugacuggagaauggggagagaccggaucaaggucagccugucuugagaucccccaaggcucccaucccugcauccacucuggaguuacaaaauggugugugucuggaauugccaacuagcaaaaccacaagugcguaacgaggaccaucuguguacagcagugccaggggugaccucacugggucuguuaacucuaccacaagcugaauagaacucaaccccuggcuucccagugcagggacggggggugggucucuaucuucauugcuauucuccacucccccccaaacaagacaccuuucccugauggaccagaaagaguaaagcuuagagaagcgauagaucuaaguccagaggcccuggugauucagaaucaggaggguuaagugauaacuuugaucccacccagaagcccaucuccucugggacccacccucuucccaaagagaaggucagggaagagacacugaaucagccgucaggaggggcugaguaaucagaaucgcugccccaagacccaaacacgugugccuugugcguacuugaaccuggccgaggaccaaaucaauagccaaugucugacacagagagaaccuguccaagcuugagauguucaaggcuguuuccuaucuauccacggaaccuguaucuauccacagaagggcugacucuggaaaggguuucugugcuuugcccauguccaaccgggaaaugcaagacacagauuuuuauuuuagaaccucugacuuacuaaucgucaguagcuugagucuuacuacaaaguuuagcuuccgugauaaaagcauaaacaaggcugaggauagaagucugugguggaggagaucagcucuaccgugugugaggccauggguuggaucugccucgaaaagacagaggaaaggaaauguaaacaggaaggcaauuagaagcucuuuguuccuuccccccuguccagaugauuggugcuacuguuauguugcaauaggggcaggaagagucacaaccauauacaauuauauacaauuauagcccccccuuaccccaaacagacuguccuuagucuaugauccagaaaugccuuuaugaguuggggaauaaacuaauacuuagaaguaggucuguauuuucuuucucucauuucuccaacauuuuuuuucuggguuucugauguuuagaaccaucaagugagauggccuggccaaguaugaugucaugcauacuuuuaccaagauuuaugauuagaaaguguguccaggaagcuuucaaaguagauugaguguggauaucaauaccccucugcccuucacacuuuuuccucaauagaugguagaagagggaaaauguuucgagcucugaugaaugcacacucacacacacacacacacacacacacacacacacacacacacacacacacauacacacacacacacacugaauggagcuggauaccuguccuggcacagggacagaaggcagagucagauggcauagcucugaccacuuuaagugacucucuuugguacagugggcccaguuugggagggauggcuaauauucucagacugaagauccuccuuggaucagguaccagcuuggacugagccuuguuccucucccacugcuaagcucuucaucugucucuaggccuugucucucuucuccuggccuccuggccuugaaccauagaguuuguaugaaguauaaaguggcccuccaaaaaaauguugauacauucaaaaucauucucccauauguuagaaaaaauaaucaauaaaucaaauccauaaucucacaaauaauaaagcuaagucacuuaucuaaauaugaaaaaguaagcagaaaugguugugcaccacaaaaauagcauuuaagcuacaacagaccacacacacagggugggaguccuaugugacagugguccaugaggucagacugacuggagacucuguucccuucucagcuugugucaggauacuauguucacacagugacgaugaacuugagcaacacacuucuuagaaugugugccuguccuuaaagcaacacaguagaggcgggacacagugacagcugaaagcaggauaauggacacuuagaugaggggaugaagguuggcuggccuguggaauguggaggauguaggcauggcagguaccccuagcuaggcugagggccuggguagggugagggcuggggccagggcagaugcucaccuucaugggggcagaagccauacuugccauccuucucaaaguuguaugugguggagcaccagaggaagccaucacugcgaccagugucuguacagcugcuguauucccgaccguugaacaggaaggggaacuugcaguacucgccaucagcguucccauacuuuacgcggaccacugcaggacacacagagccugagacccaccucucagggccuugcgcuaugggcucauccugaaagcugaguucccuccuccucccauugcccugaucccaucagagcaaaugaagggcugaaagugggguuagauugcuaggagacaggaaugaaggcugacggaagcuaucuuaccuuguccuucucccaggguccacagcucaucaucaucaaagugagaaucucccccaacaccagugcccggggcaaaggcaugugccaggaguccauccuugccaucaaauggguauccaucuccaugcucugaaauccacauugccucuuagcuguuaucauucccugcccccacagcugcauccuuaagcucagccacagccuuaucuguguuuggaguuccucagcccuccaaauaccugucccuuucacauuuccuacugggguuuuauggaauaagcaucacugggagucaauggaaaagcucucgcuugguugcucccauccuguggcccauacuccucgaggacacaugguccucuccccugcaccacagauagaccuuugcucuguucauugcuaucaggaacacuguacccacccacaugucuucagugccaccacagcaugauagcccaaucccuuccuggcauccauggccucccaucaacuccaucuuccucacuaugcucuauucucaugccagacagucaucacuauccacagagcuagccuucggacucuacuguaacagaauguuucccuuacuuacccccagguccacauugccuuucccaugcccuccaccuucauuguuuuaccuacucauauccauaccaccagccuucauacguauacugcugccagauaccaacagcucacaugguagcuuggccccagauucuauuccacuuccuccugcauugcuauugggacuacugaauuuaaauuguuaaggucuuucuuauuauguuauauccaaguagccauaugcaucuaggggcugucauuuacagggugcaguccguuuuugcugcaagcaggguauacuauacugcauccucugcuaucacagccguggcuuuccagugucuggaacaugcucugcuaccuccaucugaugagcauccgaugucuacacuucucaguaagcugcccucgggauccccaugcuucucaaaugacuaccuagcccuguugucucugugcuaccccauucuccagcccaguucugccuaccccagcguccaaaguugaucaugaugucagccuccccaucauggauucgagaaaagcgcagcggagugacgucgcuccauacuuuuaaggcccgagcaaaagcaucauccacgguuucaggguccaggucagguguguaaccaaugauccuagaagggggagaagugcauacgacugugcauauaugcaauugugcaagugucuaugugcauagagugugugcaugcaugugugcgugcgugcgugugugugcaugugugugcaugugugugugugugugugugugugugugugugugugugugugugugugugugugugcaaguguucucgugcagcagauguguugagcaaaacucacugagaacacccuccuauacugccuugaugucucuacaaucucagaccuucucaucccucauucugucugggacaagggcaccagagaaauaaacaguacaauaucaaacaaaaggcagagaucucacccuugaucgauaccaggcacauagaggagaggucuuggcucaauuagcaaccaaucauaaaaccacuauaagauuaagaacacaauuaucagcuggucaucaagcuuccuccacuugacccagugacccacccagaugacaaugacaaucaccaacacuuguagacccuugcucuguaucaaacauuguggaaaccuuugauuuacauuuaaucuaauguagcuccucaaccgccccuaugaggagcagauuucuuagcccuguuucauuggcaaggguaccaacucuaagugcaagagaguaagaccagugccucaaucauuagugaauaugagacucaaaccuagccacacaucaagaacucuguaugcaaagucccugaaugcucagcucugaggaaugacaccucauggauccccuaaacuaggaaggcaauucccaaggaagcacacaucccucaggguccugacucuguguccccccagacccuccugggcaccuguaugugaucugguucuugucccacuugggcuugcgggggaagaaguuguaguuggccacaucuggguugccacaucuuggcuuccgcauggucucgaugguguucuggucaaggucaccugucuggggcagcccaaagaacuucugcaucuucuugaggguaucuuucagcacaaagagguugcaacucuccuuggggcagccauagaaaguguucagguauugcugaaagagacaggaacucucaaagucgggauccacauugggauggcaaugcccauuaaccccaacuucugccaaacauucacuaacugggacaggauggaaccaggaaucuaaagacagugaauggagccuugggcuuucaaaugaguucugucacccaccaguggggugauucacuuguaaagggcauagcuaccaccuuuuauuuccuugaauuuauaacucaguagauauuagcuuauguaacucucucucucucucccucucccucucccucucccucucucucucucucucucucucucucucucucucucucucucucucucucucucucucucuccccgucgugcagaggaagaggaagaaucuaagaaaaaaaucagacaacuuaagaaacuugcucaagaggacaccacucacaaauggcaaaucgggauuugacaucaagcggucaugcuccagagcccaugcuugaacccucagaccccagcuucuaucugacugaaccucccagcagaccuaggaauacauuauuuuccucauauuuuuuuuucuuaugaagaaauuuaaggauugugucuggcaugggucugguagcagaccugaguucaaaucuuagcuccaccauuucuaaaaagaugcuggccuuauucuuuagauggucugccccaaacuacaaccagcugcucaacaagcaaugugugaaggccaccaugugucaaucccugugcuacugcaggauaaacugaugaucaagacaggcacuuuuacucuguaagguucaaacccuggcgcaagaaugugggugaaucacaaaugcaaacuuaaauacguggggaagucuggcuggaauggcaaaaggagcuaggaguuccggcuucuagacuggcucuuaccugcuuggaggcacucagcaaagggcaaaaagagggcaugauaguaaugaccauaauaguaauguaauaguaacaaugccugauguguauugaguguuuccuaagcgccagacacucuuccaggaaucuagaaguaccugaccaucuaucacaaagauggugccacuaugacccucugacuucaaagaaacauccacucuggaaguuaaaucagucauuagagaucaccaggccaguagguuaacauaggaugugcaggaagucagaucauguaaguuaaaagcccccucuuucucucuuucuuucuuucuuucucucucucucucuuucuuucuuccuuccuuccuuccuucuuuucuuucucucccuuccuuccuuccuuccuuccuuccucccucccucccucccucccucccucccucucucucucucucccccuuucccccuuccuaccuuccuuccuuccucccuuucuuuauuuucucucucucucucucucucucucucucucucucucucucucucucucucguccuuccuuccuuucuucuuuuuuuuuuuguuguuuucuuuugggaggggcggcuuuucacuuuaaguugaacccaguacguuccugucccggucuucccaggugugcaccauccuuggccaccuuauugagcucucuccaccuguuauauggacgccuuagggaguggagucauuccgucuacacaagggucacgccccacagguuaagaaccauugcuguaaaggaagccuuguggaaagagauuugguguccccccccgcccccccccccggcauggcaugugauuccuagucuuggauagauuggggaagaggcugacuggaagauuucuaaaaugauugaauaaaggcaauaaagagacauguccugagacccagcaaagcaucuaaaccaacccauggccaguggauggagaguggguaccgcuuugcaguugccuccccaucuagcuuaugugauggaugcgauggaugcugcugccaggacgcccuagagccaggcgcacgcucacacaacaacuaagccgcagcucuggagucuggccaagaaggaggucuuacuggccgcuggccgaccccagcccggcucaguccgcccccgccccacgcgcccuggccuucugcuccugcuccucaggccugccagccaggcgcguuguuuccuuguguccucugaucccagggaaaaguucaaagaaacucuccuuggacccuccuggacaacuucugcauuaaaacaagacaucccucaaaaugcacagucugcuucccuccagccucaaauuacuugccaaauggucccuuccagcaucucaccaaaggccugucucuagaugugugccaaaguuucccagaaguuugccaagccuugcuuuggcuauccuuuuguggccaaaggcuuauacaaauuauaugcgaaagcacacaccccauuuucaagagauucccccuuaaacugauugcccuaaaggccugacaagaugcuugccaaagguucuguugccagcucuccuguuggguccaaaagacauuuauaaagcccuccuagaaccaaaucccuuagguaaguagucaaagucccuauuauucacaaaagcaacccuuuccagauguuucccagggcaaucaucucccuccuuugcuucuuccuggucccuuggacguacccugaacucccccaacuuacuuaucaguggccucuucuuaccaaagccuccucccccccacccccacccccacccccguuguuuacaaaagccaaccucuccaucaacuggccaagaaagagacccucaaagauguuuaccaaaguuccucccaaggcugugugccaguagagggggucagaagagggaggguggccugcgucuucuauuuccuaaauuugucuaagccagcauagcaacuuaccacugccaacucuuugucuguuuuaggggcgacaucgccggggaacuugaugaugggcgauggugcagcgauggcgcggcccaacaggcagcacaggacgcagagaacccgcagagguccggccagcgcuccccaggccacucgugccuccaucguugcgcucccgggcuccgcgugucacccugaggucucuggcugugcccugggguccgcccggcuggcgccugcccugcacggcgauccccuuacucuacugccucugcuucucggggcucaggagcucauaacggggucccacgucccaauacacaccacugccgcgggugcuugcagguccuggcaaucccuuuguauaucuaaacuccuggaugcacacagagccuccagccaccagggaagucuggaugcagcggaaacaagggcgggcagacgccagauguggccggcuggg

SEQ ID NO: 12152 - RNA, 23582 nt, Mus musculus
auuacaaaugagaaaaacuuuuauuaaggaaacaauuuaacuuccguccuuuaacagauuuuuacaaaccaaagcacaauaugaagacaauuacaguuccaaccauuaacauauuacacauggugcuuauucuacaacuggaaaguugcagaaguuugugacauaccacuauaaauauaaguauuauuaaaaauuacgaauuguuuggugauuauuuugauaacuucuugagcagcagcuccuguuggaaaaaggagagaaguaaauguuugaaaagaauaaauuuuaagaguuaaguaauauauaccagacugggccugacggugcaugcuuuuaaucccaguacuaaggagacaaagacugguggaucucugugaguucaaagccagccugcucaacauaguguguucuaggcuggccaaggauauacagugaagacacuugucucaaaaaaaaaaaaaaaaagaguuggguguggugguaacggaugacucuauucaucagacuggggauguagaggcaagaugauuaugagcucauggccagucugaguuacaaauggaauuggaggucagccugguguauaugagaucuaugcuauauagaauacaccacagauacagaugaguacaaaagacaaaacaaacaaaaaacauaaagccaagcuguuuaaaaucccaaacaaacauauuuugagucauaacaaaauaaaagauaauaauuauuauuauucagggucaaacccacacugaauacuacagagcuccuguaagguacuugaaacacaaagagacagugaaauuccaccaagaaaaaaagaaucuuuucuaaacugaggcagcuucuuucuacauacugaggcuguggacuuaaaccuguacuaucaccaaaucucucaggcaccauagauguagcagaggugcaagaaacaaaaagaucugcugcuugcuaccuugggucuuucuguuuaacagcaagagaaaggauagcuuacaaauaaauacagcauauaguauguagaagacuuugugcuaugauaaagaagaaaagaaggacuaguacagaggaauggcucauguuuauauaggggaagccucagagaauuacguucauaaucauaacaaaacacauaaaacuaaagaccuaccuacacucguuaggccucucugauugugucucuuagaaucuggccuauguaaauaaguaauaauuugcccuuuccuaugaauuuacuauuuagacaugaaagaaugauuuuauuuacauaaauuauccagaaucaggcuuuaauuuguguuugcuuaaaguacaguuuucuuaggacuccaucacuagcagcauucugaacagacuacuccucaaacuggaucugccuucaacgucuagaaaggaaucgaucauaagcacacagcucaggcuaugggaggcaauaggcaggagagucauuuuuaaaaagguauuauuugcuucauguuuguacuccuucucccugucauuaacauguggacacuccgugcaaugguauuagguggggcuucugggaagugauuagaaccugcacaaauagauucaugcccuuauaaaggagauccugcagguuucuuuuuauaugugagagcaaagugagaaaaccaccaugaaugagacaggcagugagaucucuacagccucucacuaugcuggcaucugaaucuuugaaacccguaagaaauacauuucugauguuuauaagguccaaucuaugguacaguuacagugucuaacuaaacuagagcaaagugauaaagggaguuuuaugaaagaaauggcagguuuucacugggcccugaggugcaaagaccuagggcaugucucaggaaaagaagggacguagggccuuuuagucaaguuagccuuuguuuccuagaacugauggggcaggaggauucgagggggaggaggaaggggaggaagaggaggaaggccuauguguccuuguacccagagagcuaagugaggcucaugaucggaagaaggucuucagaaggacuaaagacuccagagucgcucgcucugauggcacgggagcuggcgggcaaggagagcaguguggagggcaaagcacuaauuacacuaauuacaacaaauaguaacuguaugauaacaaauaagucauuucaucuacaaaacucaccucccaggaacgcagcaaugguguguggcucagcagcuccguaccggcaacuacagaaaggauggggguuuacaguuuuauuagucucaucacagucucucccagugaguauuaucuuuauaugcucuaaagaauacucacaauucauggacauaaucgucuuucaccauuacagacagcccauauuccugaaggaagccaguaagacaggacuucaacuucccuauaucuucuucaacuugauaguuagauacuccuaaaaaaaaguguguguguguguauauauauauauauauauauauauaauauauacauuuccauuaaaauaaauaugugggcugggcacaauagugcacaccuuuaacucaggaggcaaaggcaggcagaucucuguguuugugaaugcucuguauuacguagugagugcuaagacugccagggcugcauaggcgccaggucucaggggaaaaaguaauucaaacugaucguuaucucuuacuuaauccaguuuaaaacaguaagguauaaaacuacagaacaaacauaaaccaacauuugaaaauaucagaaucugcuaaacuaaaaucuaucacaaauugaaguucaguaagucuuacucaggucuagggauuuuaacuuagugacagcauauuaucccaacauucugguggguuucuggucuuuuaagucuuagcuaauuauguuguagaagauuaacacaaaaaauacucaauaauuauuugaucaaaaaauuaaagagaaaauaccuuacuuauauccuuuaaguuaaauuucuauuuuuuuggaaacaaagucuuauuauuaaucccugcuagucucaaacuuguauguagucaggggugacccugaacuucuaauucuccugacucuaccuccugggugagauaacaggcguaugcuuuuuucagugcugaagaucucuaaaccuagggcuuuguucacucaacaacaaacuaagcuacuuauuuccauuuccagcccuuuauuuccauuuugagugauuaaauggcacugaggacauaaagcaaucguaauauacaacauuuacuaaacauuaauagaugcuggauacuauuuuauguacuuugugccuuugcacugauuuaauucucaaaagaacuuuaugaaggagccacaacuauacagauagaaaagcugggacacagacaaauuacuuaguucaugaacagcaaaacuagaauacaagacaagcauuuuguuguuguuuucucaugcaggaaaucuaauccagggccuuaggagugcuagggccacuaagccaguccuacgucauuucuuucucucuucuuuguuguuugggacaaagucucauucugcagcccagcugaccucagauucacagcaaucuuucuaccucagccuccugaauguccguccgccccauagcugugagccaccauacccaggugucaagcaucucaguaaggagagugaagaugucucuucgauauuuaacucagucaaaccuucagaaucucaagccuaggcaccauacgacuaagaaccucccucuuaaaaaaggaacugcuucagcuccaacaagaaaccagcagagaggauuaaaggccaacagaugggucaguggguaaacugugcuguacaagccugaggagcccacuucaauccccgagaacccgcauucaaaccugagcauaaugguauacaucuaucuuaucaggggaaacccaaagacaggaggacccugcuuggccagccaggcuagccaaaucugugagcccucaguucauugaaaaaccuuuccucaaaagauaaugugaacagcaacugaagaagacauuuaauauuaaccucugguccccacacauacaugcacacauguauacacucaugcacacacacuuuaaccuguuuuaaaccacuaaguuuuugagaccuacacacacacacacacacacacaaugaauuuuaaaaagacaaauauaaaaauaagacacaagagauaggacuggagagucaguucagcaauuaagagcacugacugcucuuccaaagguccugaguucaauucccagcaaccacgugguggcucacaaccaucuguaaugggaucugauguccucuucuggugugucugaagacagcuacaguguacucacauacauaaaauaaauaaaucuucaaaauugaaaaaagaaaaaacauacaaggacauguuagugauacacauucaaccaacauucuucucuaacaguuuagaaucaaaugguuuaaaaguagugagccuuaaaaaacaauagagcacugggcuggagagauggcucagagguuaagagcacuggcuacucuuccagagguccugaguuuaauuccuagcaaccacaugguggcucacgaccauguaauaggaucagagucccuccucuggcauguguguguguguguguguguguguauguauguauguauguauguauguauguauguauguauauaaaaauauguauauaaaauacacaaacaaucuuuuuuaaaaaaaaaucaaauaauaguuccucuaauauccacagaauacuaaaauucaggucaaguggguuuuccugugugguugguuggucuuuuuugagacauauucucucuacauagcccuggcuguccuggaacucacucuguagacuuggcccagcucugccucuagugcugggauuaaaagcaagugccacuacaccuggcaucaagucaagcauuuauuuaagacuuuaaugagugaaucugauggcucaugccuguaaauucaauacuuuggagacugauugaggaagaucacaaauucaaggccagcccaagcuaauaaguaagauccugucuuaaaacaacaaaaaagccaaaagaucuucuuuguaucugguaaaucaacugcuguucuuaccuggguaucugccaugcuguuuaugaaaucgaucaacagcccgcaacaucagguacaggacuaucucauuauccggauuguccaugcuagaaacugaaaggaaaaaaaaaaaaucaguaaaacuagauaacauacacaagcaacaaaaggcugaauucauacucaaguuucaggauacaaaauaauauuagcaaaaaauauuaaauauuuuauuaaaauaaaguauaaaauuauaaauaagaaauaaauacauuaagguguaacacaaggggucuuauagacuccuagcuggagucucuaccaagguagaaacaugauaauguuaguucuauauagcacacaaugcagucaguaaucuaaacacauuuuuauguauuuauuucugaauaauauauguaaauuaaaaucauucagguaaucuaugaaauauucacauuauuuuuauagcaccauuuauucagcacuauuauacacauuuuauuaguaucuuuuaacuuagcaucugguuguuauacuuacuaauuucaucuuuguugacuguauccaagccauacucuucagcuaaagaucgacaucuuaccacucgaagaaaugcagaauugcugccuggaaacaguaaagacuucaggaagguugugacaacugaauacaccaaauuaugggucacuuuaugaacaagaaauuagggcuacaagauggaucagcagcuaggagagcuugcuguuaauggagaggaacugaguucaguucccaguacccaccugcccacagcaggccucaugacuacuuauaacucuagcuccaaggggaucugacaucuuugaccucugcaggugcacauauccacacacagauaggcacauacacauagcugggugugguggcgcacgccuuuaaucccagcacuugggaggcagaggcaggcagauuucugaguucgaggccagccuggucuacagagugaguuccaggacagucagggcuauacagagaaacccugucuugaaaaacccaaaacaaacaaacaauuuaaaaacaauaaacauuuugaagcauuuauucauuaaaaauuuuauugagugaccacaguacuguggggguuuuguuagacaccgaauauuaaugguaugaagaaauugcugccuugguuauagucucaguuuggugugugaggaaggcuuaaaacaaauguguguguccauguaccuguucuuugggguuccuccgauuaacugauaggccaucuuucuaacccggcaacuaacuuuaugaaacuuuuacuucugugugugauauaugcauggauaugcuuagccacccgugaauauguggugaauauguggugaccagagauugauucugagugucuucuaugaaucgccacuguauucuuuuucuuuuuguuuuuauuuguuuuccaccuaucuuuuugagacaggaucuguuugcauggcaagcacuuaacccgcugagcuaucuucaaccugcaacugacuccaagaacacgcuuuuaccgccucagaaauuagggagaaaaccccagaagcccagccaugaacuaucaugacaaauucuuaauuccauuagucacuuaacacagaucaaaugaguaccaauggcccagucuuaaaauguccuuuagaguacaaaaaaacaaaauaaaauuuaccuaaggauacacacacccuacuucaagaauuucaaccauuuaaaacucccaagaacacccucuguagcauacuuuuauuaagcaaaauaagaaaauuaaaaggacuuacaaagcaauuuuaauucuuucucugaaauggacucuggugccuauaaagaaauaaaugcagguuuuucucuagcacgcacacacacagagacagcaauggcacagcacaaagccaagagcugggaaaacacuccaaacacaacuguucuccuguaacaggggugcucauuagagacaaguaggcacuucugccaaagaagcaagccagggccccgccuucccucucuaaccccucccuggcugagcuccuugcugcggggagaaguacuguucaccacuuaccuggccaacagacugaagcaauuuggcaacgugauugccuacagcagcagcaucuuucuuugcuuucucucgguaacuggaaaagauugacaacaacaaaacccuacaauuaaugacuccuaaaauuagcaaagcuaaagucaucuuuaagugaacaaaaguuuauuuuuaauuuaaaaauguuuggaaacauaugaaaugugaaaaugguagagaauuaucaccaguagcaccucucaccaguuaggugucauggaagagcuggcaguagaguccucuucuggaguccucuaaagccaaagcucccauuauccaucccuacagcauccaacuucaauguacccaggugacaccugucaucccuacagcauccaacuucaauguacccaggugacaccugucaucccuacagcauccaacuucaauguacccaggugacaccugccaucccuacagcauccaacuucaauguacccaggugacaccugucaucccuacagcauccaacuucaauguacccaggugacacucgugggagucuuucuuuugagucauuuucuuuuggucauuaaucucucguaacuuaaggaaucaaugacuguagauaaacaccuguuauccaguauaccuccucugacacacauggacccguaaggucaggucucccuggauguuaccuucuuuguaacuaauguacagagcugaugaaugcaaggaaccugaccugguuuccuccagggccaaagguugccauacagagaagaucuuggucaguguuuaacaaaucuugguuuguuguccuaaucuaugaguuauaauacugaaaauuuggcaaaggacaacugaagacagaaacuaauggugacuuuagggacauugcucagagguagaacucuugcuucacauauauaugaggacccagguucaaucccaauaguacaaccuucacccuaaaaggugugcccuuaccugggagagacucagcauuaauacuagucauuuuuacagucaaauauaacuagauauuaaacaaaguuuuucaugacuuauacuauuggguagguuugaagugugugguuuuccuuggacuuaacuucaagaaggugaguuguucauguaacauuuuuuuuagguccucugucagaaaccagggucugagucccuuuaggagggcagauuuaaguagccuguuacacauaguuuaaaaacagugauaaggcaugguggcacauuccuuuaaccccacugaauucaaggcuagccuugucuacaaagcuaauuuuaggacagccaaggcuacacacaaaaacccuguuuugaaaaacaaacaaaauaaccacaacuaaaagacacuuacacauucugcaguuuuauguauuuguuugaaucugcaaucauaucaggaauugugccucggacagguaaauuuccuugacccuccuuggccacaaauuccuuuaaggcacgagcuagaauccaaaaaguuggugucuaaaaaaauaagaaaaaacuacuauaaagguguguauucugagcuggaguugaagacagcuuuauuuucccuucuuguuguuaccuguuuggugauauuuaugcaucgaucaucauuaaauauaucuucaauacugcuugggaucuaacaaaggaacacaagacauuacuuacauuaagaaugcuguccaccuuuauuuucaaugcuauuucuucaaauaaguccuuuauauuuucaaagugcaguaaaauaucaacuucugauguauuuaguuuuauuuacaaucagauucugauggagaucugaugggaaagagaauggaagaaaauccucuccuggccuguuagcauuucagacaagucucccauauccacauggaguaaaggaaaagccaaacaugucauucuauauacuuuguaucugaagacaacaaugacuacugacauugcuacaaagccagauuuaaagcuguucaugguuucccagcuuaugaaaguccugaaauucauucacccuaauuccagggcuguucagagaugaccacucuaacaaaaaauaaguaauuaugcaauuugaaacucacaaggucaccacacuaauaacuuuacaaacuauaggcuuugauucuaugcagacaaaauagaguucucagugacaaccucgugacuggugucuuggcuuccaaccccacaccucuacuguauucauaagagucaacagucuuuugaauggcccacuguaguggcacacaucuuuaaucucagcacuagaaggcagaggcaggugaaucugugugagcuccaggccaccuggucuacuaaugaguuccaggccagcuagcacuauauacagugagauccugucucaacaucaaacagaccuuccuacuucccugcucaaaacccuucuaggucugcgagauucugcuaugguauggcccuuucuagcucuccaaacucaaaucuugccuaucacuuucuuuccccuucaaucguacugacuuuccuacugauccuuuaacucugugcccugcgcccgugcccucugcuugagcagcucaugcaacagaccucuggguggcacuucacucaggccuuuuccuccuucccagcucccucucuaacacugcccccuagguacacccuauccaauacccagaccccuucuugccuccucacauucuaacuuuguucauacauuaauauccaauuguucaauuuacugcccccaacuccuagaaccauuuuucuguuuuauuuuucuugugcccagacuggacuagaacucacuaugcagccaauguggucucaagccucuuccuccaucuccuugguucuggcauuacaaguacaugccgccaugccuggcuuuauaaucauccuuuaguuuuaaaaacugaucauuacauuuuauuuucaguaaaaaugcagaucuaacauguaucauuugauagcuauacauauacauuuucaacauucuuuccaauuaagauaaaagauguuccuuagcuagaaugauuuacaaggcauacacucaggaaccauuucagggucuucaaaaugucuacagugacuugagugcuuuccuaaugugaaaggcaguacucaagcuauaaauuguaaaaaaaagaaaaaaaaaaacuauaaaaaaucuuccaggugucuuauuccacaguuccucaaaaaugaacgaacaaacuuagaagaagaagaagaagaagaagaagaagaagaggaggaggaggaggaggaggaggaggaggaggaggagcaggaggagcaggaggagaaggaggaggaggaggagcaggaggaggaggagcaggaggagcaggaggagcaggaggaggaggaggaggaggaggagcaggaggaggagcaggaggaggaggaggaagagaaggaggaggaggaggaagaaaaagaagcagcagcagcagcaacagcagcaacaguaguaguaguagucugacuuauuuuccgauacuuuuuauguauucuaaguugggcuuaaccucacucuguagcccaggcuggcuucaggccucagauucagaauccaccugccucagccuccaaagugccaggauuacagguguaaguuaccauaucagcuuauaauuuuugcaauguacaagucauugagaacaucuccaauuaugucuaaauaacugcugcaaaaaaaugcaagauaacaaaauuuaacuuuugaguuuaguacuucuuuugacuagcaaacuaucauuuguaagucuuaccuccaaauucucaacuauucauaaaucauauuucucuaagugaaagaaauuacuuuauuuuauugcuauuauaugcugaagcacagacauaauuuuaaugaggauaauauagauuuuuuuuuuguuuugagccccagcuguuucugcacuugcuauguggccaaggauggcuacucaucaccuugcuccccucccccagggguggagguacaggcauucaccaccaugcagggcacaaaacuuuauuaaagccgggcgugguggcgcacgccuuuaaucccagcacucgggaggcagaggcaggaggauuucugaguucaaggccauccuggucuacaaagugaguuccaggacagccagagcuagacagagaaacccugucucgaaaaaccaaaaacaaaaaaaaacaaaaaaaaacaaaacuuuauuaaaacuaaacugcuguuuuccgcugggcauggcacauacuuguaacacuugagagguggaggcaggaaaagugucacaaguucaaaaccagccuggucuauacagcaaauuugaaaguagccugggcuacauaaaaagaccuugucuuaauaaaaaacaaaacaaaagaacccaaacauucuuuguuuaggcauuuaggcaauauuagguuaaauuguuauaucaacuuucacauaugaaaacaucagaaaacacagugguuucagcaguuucuuugauaccugaguuguauuuagugcuguguucacauuuuugauggcuucuucaaaauucucuucgucuucuggagcuccauuuucauucuuuaaaaucccuauuaaaacaagaaauagcuaacaaugucuccuuucacuuuggcuuccaacauuauagaaaaaucuuaucaggagcugaacagaggaccacagugcuaacccuuacaggaaacacagccauuuguucuuccuaaacucuuuuuuuuuuuaauuuuuuuuauuuuugagacaggguuucucuguguaacccuggcuguccuagaacucacucugcagaccaggcuggccucgaacucaccuggguaugccucucaagugcuucuuaaacucuuuaagaaaugauaccuuuacccccagggaaaguaaaauaggaacucaugacagcaucaucugacaauaaauauugguuucaagcaauucuuuuucaauauuuaauaccuuauaugcuuuauauaauacuuaauuacaaugcagaaaauuaccuugucuuaucaaaucucugaaguccucuuuuucuuuauaacuuuuaggaauccguccauuugucuaaauugauuaaaauauuuaaagaucuaguuaucaaaacucaaaauauggaaauugggugucccaugguuuccccauuauaaaaucacugaaacagaggcuugcuuaauuuggaaaguguaauuguagaccauuucuuuacauucauucugggugaaauuuacuaaaauuccuauuuguuaauuaaaauaucaguacugaaagagugauagcuagacuucaacugaaaagcucccacuugcauuacauccucacaagggaaaacauuaaccucccauaacccucuaaagaaaucccuuaucacaucuuggaaauaauaguaauuuaauuaaaaaacaaaaaguacauacuucauuauaccacugugcuaaauauuuagcuaugaucacaauccauggaguauggcuaugguccuaaaauagaaacacaaauugaagaaaauagcaguauuaguuaauauuaacucuucacauaccaucuuauuuucaauauuuauaauuaucuucuaauccacaugaaguaauaaacaggcaaaugaacugguuuaauaaaacugguuuuagaaaugguuucugaguggcuguggaguagcucugugaguaaaaugugugccagacauggcuauaagcuggaaccucagugcauaaggucaaggcaggcagauccuggaucucauuggccaaucauagaugaauggcuagcucuagacugaugagacacugucucaaaauacaaaguagaaagcaacuaagagaaccugagguugaccucuggccuccacaggugcaugcauagguuucuguaaaaauacacacacacacacacacacacacacacacacacacacagacauagacauacacacacagacauagacauacacacacacacacacagacacacagacauagacauacacacacauacacacacacacacacacacagagagacauagacauacacacacacacauagacacacacacacacacacacacagacacacacacacagacacacacacacacacacacacauagacacacacacacacacacacacacacacacacacacacacacacacacacacacacacacacacuaaccuuuuuuuccauaugguccaagucauaagacugaagauguucucucaguucaggaaauggcuuaucuagucguagauccuccaaugcauuaucuggaugagauucuauuacugucaagcaaucccaaaagauaauucuuuacuucauuauaggaacguaagacacacacacacacacacacaauuuuguguaauuggaugguuggaaauggagucuuacucuauagcccaggcuagccuugaacucauggcaauccuucugucucaucauccugguuguugucguuacaggcaugacccaacgcaccaggcuggaaaccuauacuuuuuuuucuugagacagggucucacucuagccucgacugcuucuuuuacucaaugucaguuacucccacuuccugaucugacuuuggacacugcuuuccacaugagggauacaaaacaaugcacaacuucaauuaguauuuguaaugagguuauaagucugccacuugcuaugucacuuuagacaaguaacaauuauauuucugugcagagauaauaguaucugcuuaauaagguucuguaaagaguaaauaagucauuuacaucagagcagacacacagcuaacagugcugaccuucaucaucacccacuccugagcaucuccccuaaguuggaggcucucacccucucccuccucccuucuuuaccucacucccaucgcaccccugcaaacuuggcuccuuuaaguccacucauucucuacucauacucuaacauuagagcgaucaacuuaaaacacaaauguuaucccauugcuucccacuuuuaacucuuaaauggccugacgucaucuaccaaaaguguauccuaacugcccacaugacacuaagccuugugaggcuucaguguuaauagccacuguuacaccaacagagugccugguucauauaauagcuggcuuagaaugaaaacacuuuauuuaguagaagcauuuuuacugaauacuaaaggaaaauuuuauaaaauucuaagauuaagauucuauaguacaagcugauaucagcucugggcugcuguaggccugccuaugaaucacugguuuccuuuaacacuguuuccuuaggaauaguagcucggaaaaaggcuuaucauauguaacuggacguggaauggagaaaucuaaggccaauauaagacugaaaauaaagacaggugggaaauggugguguaauggagaggcaaaauuauuacuuuuauucuguauguuacuauguaugcugugcuauaauuacagcuaugcaacuaugaaguagcaacaaaauaauuuuauggcuaggggucaucacaacaugaggaauuguauuaaagggaaggcugagaaccacugauguaguguuugugucaaaguggcccacacacuccuguggcaaccauagauguccuauuuuggguuggggagcaaaagaaaccagguauuuacauagcuccugggucucuuagcaagacaaacaagguguauguuaugucucuggccugcauccauuuauaaagcuauguaaggaaauagucaaaacccuuugaaucaggcuagagauggcuuaaugguuaagagcagugguuacucuuccagagaauccagguucaagucccagcacugacauggugguucacaaccaucuguaagcccaguucugggugauaagagguccucuuuuggacucuguaggcacucauauacacuugguacacagucauacaugcaggcaaaacaucaauacacauauaaauaaguaagcacauaaaaaaacuauugaaucuuauugccuuuuugaaccuguacugcuagaaauuuauuucauaauucaaaacaauuuaaaaauugugacuuccuaaauuagcaaguuucuaaaauuacugcucaaguaaccauuagcaagucccauaugcuuaacaauuuuaccuggguguucuuuuauaauaauccucauauaaccaacuaguccauauguccuacagaucaaaagagggaucugggaauuccagagaacaucugcuaaacgcagcaauguacugaaaaagaaggcaaaguaagaacauaagccagcaaguauaugccagacacgggaacugucuaacauaaacaggcaagaacacaguggaaagcaagugauuucauggggcaacaaccucacaagugcugcacucgagggaugagaaaccccagucuguaguacuaggaagaaugcugaugaacacacuaucuaaacauuuucaucauaguggaacauuuccaaaacccauagacaccuacaaauccuccuguaaccacggaacugcuuuauuuuacuuuucuugguuuugguguuucagaaacacuggagcucacuacgcagcucaagcuguccugaaacucauuguguaggccaggcuagccucgauauccugaaacuuauuguguaggccaggcuagccuccaacuccugauccucucucucuggcuccugggugauggauuagacugcagugaauacuaccauaccuggcuucuaauuaaucuuucaucacuuagcaauagcuaauguucacuuaaguuacucuaaacauauccaaauaucuaacuuuuuauuccccauacaagaguuucaaaugaaaagcuucuuuaagaauuuuagaaacaagacaaaauauguauacagaaagauguacauagaaaacuauguaaaccaagcaagaccaugaaaaauauuaacaucgaaaauuuaccuuucaagaagcugaguugcaaccacaauaguaaaccuacagaaaaaugaaggaucauugucuagaagguuuucuggacucuaaauaagacaaggggaggaaaaaauucaacaguuucacauauuaaacauggcagaaacacauaagcuauuuuaauauaaauuaguugacaaauuaaauuccaacuaaauauaaaugacacaaaaauucagaauucuaaguuuuaggguuuugaauaauuuuuuaaaacacacuguagcaaaaaaauaauaauguauauauauauguauuauaccucuuccacaaaacuuccagagacaucgcuauuuaguucuuguaagaauuccauggcagcuugagcucgguucuuuucaaagacaaagcauuugauuugauuuagaaagugcuuggcuacaaugugauccccacacuuacagauuaagaaaaacucaaugugaaacuuuccaaauuccaugcauggaugugacaauucuccuucucaugauuuaacugagguccaaguagaacguuacucagguugaacuaagcuaucacuuauagaguuguuaaaugaccacguuauuugcccuugacuuuucugaucagacgaaagagaaaaccaggcagcaagcagggcugugcugaaucccguucagacccugucuaccuacacaagaguggccaaucacuaaagcaagcucaacuccauucagaauguaacacagcuuucauuugaaauacaaaagugucugugugugugugcgugugcgugugugcaugugcguguguaguuuaaaaacuaagguuuucauuugauguauuaaaaaaaaaaaaacuuucugguuaacuccacuuacuaauuucuaccacaguacucuauccacugaacaucaaugucacucgagucucuaauaaaggacaguguaaagucgcaguacucuaaguucuuaaacuaccaagagaguuaccagauuagaaagugagcuaaacccacuuuucccucagagaauaagaucuuugaaagucaaaacuuuuuuagcggccaagguauaguggcacuauuagaugcucacacaccaccauacucagucacggacugcuuaccuugccaauacugcuuuuuugaaggaaaaagcugaaggggauagaaaaaagccaagauuuauauggcuauaaagcaaaaguuguuuaacauuuauaauagugugcaccuugcauucaaaagggaaaacaaauguguguuuuacugcacucuaccacugagcuauccccacaaacacuauguccacagcugauguuaagucuccuugaaggaagggguggguaaaucagcguccucuauggcaccacuucacagcaugcgcugagagaaaagagucccaagaacgagaaaacaccacauggccuaucuccucccuggaaaguccuaauguaccucaaaagaacgcuuuauaguaaagagguuuacagaaaccucuuugacccauuccccaaacucguuugaccaugaaauccacuguuccauuuaauggcuauuaacauuuccuauaaccaauguucugcagacaccugggaaaugcuguagugaacgauuugcuuuugcaagaaauuauaaaagauucauucagacuuccucccacacauacucuggucacgucccaaaggcccauacuguggcugcugaugagagccagggcacaauuuuguggcaaaagcacaugguuccguaagaaaaaaaaacuccuuaguguuaguacaaaguaaugauuguauuauucuuaaaccauccugcagagucagcaagguaagcaacaauaauagaacuuuuauuauuuuauagauaccaauaaaagaguuaugcuguagauagcauaaauauacuaugcuccaaagaaaacauaucaaaggaaauaugaacuaaauccugauuuuccuugaauuaauauuuacuucuuguuuauggacaaauguaaugagagauuccuagacucuaaccacuuuaaaacaguaaguacgaaaucaaauuuggaaauguucugaaaaaucaaaguaugacuauauguaaaaaacaaaacauaggucauauggggcauuuuuauuuagcauuauagcacaauaagaaauauaucagacuaagaagauauaaaugaaagauauuguucuuauuccuuuuuuaaaauuucuuuaaaagauauauuuauuuauuuuauguauaugaguacacuguagcuguauagaugaugguuugagacaucuugugguugcuaggaauugaacucaggaccucugcucacuccggcccaaagcuuuauuauuauguaaguacacuguagcugucuucagacacaccagaagagggcaucagaucucauuacgggugguugugagcagcuaugugguugcugggauuugaacucaguaccuucagaagagcagucagugcucuuaaccccugagacaucucuccagcccuuauuccuuuuuuuaaagacaaggucucauuuuuuuagcucuagcugacggcuggucuugaauuuaaugagauccaccggccucugccuuccaagcggccucugccuuccaagcguuggaacugaauucauuuucuuauuccuauaaucccccaauccaaucauacucuucacuaacacuaaggaauuaacgccaggacuuagaaagcacucagaacucacagguaagagaaaaaugacuauuguuuugucugacagcaguaaagacagugacagacccugggugacagugagccccaucugcuaucggccggcuugccagacccugaguaacaugagcccaucugcuaucggccggcuugccagacccugucuuagcacuucgacuuuagucacuucuucaccauuaucuaacacccagucacaagguuaaaacugcucaggccucauccugagugcucugccuucucuaccaggcuuauauuuucaaagacagacauacuuguuuccagcaucuucuccgcugaccagauuuccaucaauaauuguaaaugauccaauaccuagggagacaaaguauagucacagacauguuuuagguuuuuuuuuuucuuuguuugcuugcucuuauauuuacuguuugaaugugagcgcacaugugccaugcacacaugaggaggucagagaccaaccaauacaggcugcacagaccaaauucaacuugucaggccuaacagcaaguaaccagccacuaagccacccugucagccuaagaagaucuaccucuguaucagagacuaaagaagucaccgagaaugcaaucacaggugucaccuuaccuggcagcaccaaguuuuuaagaauuucaguuccuguagccguugcauuuauuaagcaaacaugagcagauuccaaagcuucuuguccaugaucaccccacagccuauaaaacaaaacaaagauugaacauuaaaaaguucacaaaguaugacuuucuuauuugaauggugauauuuacaauauucuuucauaaaauaacauauaccaaccacagcaaacacgugggaaaggagcugauaauguguggguuacaugacaacauaacugaaaacuuugauaaaccauacuuugcaugauauaaucaauauuauuacuaaguuuugccuuucugaucuuuucuguuacuucuuucaaaccagguaauuuauaaaacagaaagucuagguagagucgucaacauucaagaaauguguuagccaagaaagcacuuaucgucucagcuauucaggaggccgacgcagaagagucuuuagaagcacguucagggucaaccugagcaacaaagagaggcccuaucucuuuaaaauacauacauacauaaauaaauaaauacauaaacagauacgugaauaaaggaagcuucuugcacuuaaaacauagucuguucucaaucucauuucuucaagugaugcagauccuauacauuuaaggucuugacauaagauauuuauuucccuguaacaucacaaaaauaagcaaaaauuuuaucaaggaaacuugcuuauuaucaucugaaaaagcucacauugaaguacuuuaaaauauaauaacagguauuacuauugcccuugguugccuucaagacacuaaagguuaagucccuauugcugaagacaccaugcacuucagacacaagaucuagaggaccucagcuggguuugacccggaagccuucugcaggaagaccagcuuuugcuguauacaaacuuucaagggagagaaaccguggguaguucuuccagcuguaauggcuaugaaacacaaaggcuaugaaaccagcauggagugacaacgugaggggcaauaguggcacucuuauauuggugguaaccaacagcuagcucuccaguugcacuuaaggcuugcucagcaggagagaaaucauaccuguuacuggaaaccuagccaacgacccaaggcuagaggugucauggaugucagagaagaaccuguugccaccacuuuacuaaaucagcuaauuccuaacugcauucuaaaaauuuauucuuuuuuuuuuuuuuuuuuuuuuuuuuuugagacaggguuucucuguguagcucuggcaguucuggaacucacucuguagaccaggcuggccuccaacucagaaauccgccugccucugccucucucucucucucucugccucucugccucugccucccaagugccgggauuaaaggcaugugccaccacugcccacguguguguguguguguguguguguguguguguuuaacagcaacagagaaaaagaggccgagauuucaaaaaggaacaaggggguccaugggagggacuggaaagggaaaaaugauauaauguuuaacugaauaaauacauacauacauacauauacauauauauauauauacacauacauacauauauacauacauauauauaauagccagugaacauucuaauuucuaauaggaugacuaagagaugcacacaucaauaacacagggguguaauaagaauuagaaacacauauuauaaccugauugagacuggcauaucacuaacaagacaaaguucaugaccacacauguaucauguuuuuugggccagguuugccaucuuuauucccccauuccuugacacacauauguuaucuccccaaaucccaaccaaccaacaaucuacuauuuucuuuucagaaugggaaauaauggggaagcccaaauuauuugaaaaugccauugccauacggguacuaucagaugcccggggacuuaaaaaaaaaagacuuugacacuccuuccaugucaccaauauaaacaaagcuuaucacaacaaacugcaccacuugauuuuccauuuacugagcauccagucuucacuuuaaagggucccagaccacacugcuggcacagggcuuugccuagaggaacugaucacucaagggcuggcaaauggagaaacaagcuugggaaaaaaaucagagagaccagaaagacuuuuucucuucccaggaaaugggacacagucuuaucugaguacuaagugguuggacaguugaagaauaagccuaagaguacaucuucaagauucagcaagaaaauguucuugcuggccugagaggcgggccuuggucccuggcuauuaccugccgacccaacuuuguuucugcuuccuucugaccugccuacagcaaaaagcaguucuuguuuugacagauaaaaugcagcccuuuaaggaauaacucaguaagaauccucuuccagucccuaggaacauuaaguaucuucucagcuuuguugccuucccuucuaccuccacccaaacacagaacuacgaguccacaagaacucagaguaguuacaagggcucugcuaccuuguuucucucucuagaagcuugggacaaaggaugagucugaaaaagccagguggccccaagcuggaaacaugucuaacucugggcaaauuaaccuaacuuuuacaagacuuaguuucccuauccaguaucaaagaccgucugccuucaaggauucucagaacuaaguaccuacgucucugggagaguaagagcuagguagucaauacaaagagaaaccuccauccuuagggacacaggguaaguucucuugagauuaagagaggcgaggggauggcaacacuuugauacacuuagcugacacagaguauacucaauaagaaaggaagaaggugggaagagacaaggaaggagaaauagcuaaagaauccaccggaugguuuagaugugcccuguccaaaugguuucugaguacuagaaaugcagcuggcaugaauuaagacauuuuuaaaauguguaugauaccugauuuauaagacucugugaacaacaacaacaaaaauagcuugguaauuuuaacaauaauuacguugaaauuguaauguuuuggaauacuagguuagauaaacacugucaaauuugauucugggauuggggaauguagcucaauuuggcaagcaggcaugauguccagaguuccagccucaauacuucauaaaccggguguaauaguccacacuuauaaucucagcuguuggggaaaaagaggcagaaggauugcaucaagucugagcgcagucugcucuacauugcaaguccaggcggccacucaaagguaaaagacaaaaaaaaaaaaaaaaagggguggggugggggagcaaaaacuuauuuuugagucuggcugggcagugagcaucuucaaucucagcacuugagaccugggacguaggcgcuugaguucaagacuggccuacuuaagaccaugucucuauauaaacgagagggguggggagaacuaguagcaaaacuuauuuuccugucucuuuauucucccgguucccaaggucuuccaauggaggccaggcuggcuuucaguuuccgauccaccugccucugcuucucaaguccuugggauuaccaugucuagcuucuuuuaacuuuauuugaaaggugccuacuggaaaauguguaauuacgaacacgguuugcuccgauaaagcuagcaugacgcauuucuauuggccagcgcgggcguagaccaauaccugccggggcgcagcgcucggcggucgggcaggauggggugcucccaccccccucguuuagcgaacgaguagggagggccugccgagacugugcagcccaguggguuggcggagacaccgcgcaccgcaaaccgcggacagccagccgugcgggaaggggcgagccggccuucgccgaacacucgggccaguggccggaucccagagcgccggcuccccacgcccugcacggccggccgcagccgcaggcccgugggaggccggccuacccggccuaggcacuuaggccccgcgggugucaggagagcccgccagccuggccggcuugcucacucguaaaccccggcucaccucagcugccggucguacuuuugcuccuugaguaucuucccuggcugcgccauggccgcgccuggcccgcgaacagcaaagccgccuaaggaggccg

SEQ ID NO: 12153 - RNA, 23582 nt, Mus musculus
cggccuccuuaggcggcuuugcuguucgcgggccaggcgcggccauggcgcagccagggaagauacucaaggagcaaaaguacgaccggcagcugaggugagccgggguuuacgagugagcaagccggccaggcuggcgggcucuccugacacccgcggggccuaagugccuaggccggguaggccggccucccacgggccugcggcugcggccggccgugcagggcguggggagccggcgcucugggauccggccacuggcccgaguguucggcgaaggccggcucgccccuucccgcacggcuggcuguccgcgguuugcggugcgcggugucuccgccaacccacugggcugcacagucucggcaggcccucccuacucguucgcuaaacgaggggggugggagcaccccauccugcccgaccgccgagcgcugcgccccggcagguauuggucuacgcccgcgcuggccaauagaaaugcgucaugcuagcuuuaucggagcaaaccguguucguaauuacacauuuuccaguaggcaccuuucaaauaaaguuaaaagaagcuagacaugguaaucccaaggacuugagaagcagaggcagguggaucggaaacugaaagccagccuggccuccauuggaagaccuugggaaccgggagaauaaagagacaggaaaauaaguuuugcuacuaguucuccccaccccucucguuuauauagagacauggucuuaaguaggccagucuugaacucaagcgccuacgucccaggucucaagugcugagauugaagaugcucacugcccagccagacucaaaaauaaguuuuugcucccccaccccaccccuuuuuuuuuuuuuuuuugucuuuuaccuuugaguggccgccuggacuugcaauguagagcagacugcgcucagacuugaugcaauccuucugccucuuuuuccccaacagcugagauuauaaguguggacuauuacacccgguuuaugaaguauugaggcuggaacucuggacaucaugccugcuugccaaauugagcuacauuccccaaucccagaaucaaauuugacaguguuuaucuaaccuaguauuccaaaacauuacaauuucaacguaauuauuguuaaaauuaccaagcuauuuuuguuguuguuguucacagagucuuauaaaucagguaucauacacauuuuaaaaaugucuuaauucaugccagcugcauuucuaguacucagaaaccauuuggacagggcacaucuaaaccauccgguggauucuuuagcuauuucuccuuccuugucucuucccaccuucuuccuuucuuauugaguauacucugugucagcuaaguguaucaaaguguugccauccccucgccucucuuaaucucaagagaacuuacccugugucccuaaggauggagguuucucuuuguauugacuaccuagcucuuacucucccagagacguagguacuuaguucugagaauccuugaaggcagacggucuuugauacuggauagggaaacuaagucuuguaaaaguuagguuaauuugcccagaguuagacauguuuccagcuuggggccaccuggcuuuuucagacucauccuuugucccaagcuucuagagagagaaacaagguagcagagcccuuguaacuacucugaguucuuguggacucguaguucuguguuuggguggagguagaagggaaggcaacaaagcugagaagauacuuaauguuccuagggacuggaagaggauucuuacugaguuauuccuuaaagggcugcauuuuaucugucaaaacaagaacugcuuuuugcuguaggcaggucagaaggaagcagaaacaaaguugggucggcagguaauagccagggaccaaggcccgccucucaggccagcaagaacauuuucuugcugaaucuugaagauguacucuuaggcuuauucuucaacuguccaaccacuuaguacucagauaagacugugucccauuuccugggaagagaaaaagucuuucuggucucucugauuuuuuucccaagcuuguuucuccauuugccagcccuugagugaucaguuccucuaggcaaagcccugugccagcaguguggucugggacccuuuaaagugaagacuggaugcucaguaaauggaaaaucaaguggugcaguuuguugugauaagcuuuguuuauauuggugacauggaaggagugucaaagucuuuuuuuuuuaaguccccgggcaucugauaguacccguauggcaauggcauuuucaaauaauuugggcuuccccauuauuucccauucugaaaagaaaauaguagauuguugguugguugggauuuggggagauaacauaugugugucaaggaaugggggaauaaagauggcaaaccuggcccaaaaaacaugauacauguguggucaugaacuuugucuuguuagugauaugccagucucaaucagguuauaauauguguuucuaauucuuauuacaccccuguguuauugaugugugcaucucuuagucauccuauuagaaauuagaauguucacuggcuauuauauauauguauguauauauguauguauguguauauauauauauauguauauguauguauguauguauuuauucaguuaaacauuauaucauuuuucccuuuccagucccucccauggacccccuuguuccuuuuugaaaucucggccucuuuuucucuguugcuguuaaacacacacacacacacacacacacacacacacgugggcagugguggcacaugccuuuaaucccggcacuugggaggcagaggcagagaggcagagagagagagagagaggcagaggcaggcggauuucugaguuggaggccagccuggucuacagagugaguuccagaacugccagagcuacacagagaaacccugucucaaaaaaaaaaaaaaaaaaaaaaaaaaaagaauaaauuuuuagaaugcaguuaggaauuagcugauuuaguaaagugguggcaacagguucuucucugacauccaugacaccucuagccuugggucguuggcuagguuuccaguaacagguaugauuucucuccugcugagcaagccuuaagugcaacuggagagcuagcuguugguuaccaccaauauaagagugccacuauugccccucacguugucacuccaugcugguuucauagccuuuguguuucauagccauuacagcuggaagaacuacccacgguuucucucccuugaaaguuuguauacagcaaaagcuggucuuccugcagaaggcuuccgggucaaacccagcugagguccucuagaucuugugucugaagugcauggugucuucagcaauagggacuuaaccuuuagugucuugaaggcaaccaagggcaauaguaauaccuguuauuauauuuuaaaguacuucaaugugagcuuuuucagaugauaauaagcaaguuuccuugauaaaauuuuugcuuauuuuugugauguuacagggaaauaaauaucuuaugucaagaccuuaaauguauaggaucugcaucacuugaagaaaugagauugagaacagacuauguuuuaagugcaagaagcuuccuuuauucacguaucuguuuauguauuuauuuauuuauguauguauguauuuuaaagagauagggccucucuuuguugcucagguugacccugaacgugcuucuaaagacucuucugcgucggccuccugaauagcugagacgauaagugcuuucuuggcuaacacauuucuugaauguugacgacucuaccuagacuuucuguuuuauaaauuaccugguuugaaagaaguaacagaaaagaucagaaaggcaaaacuuaguaauaauauugauuauaucaugcaaaguaugguuuaucaaaguuuucaguuauguugucauguaacccacacauuaucagcuccuuucccacguguuugcugugguugguauauguuauuuuaugaaagaauauuguaaauaucaccauucaaauaagaaagucauacuuugugaacuuuuuaauguucaaucuuuguuuuguuuuauaggcuguggggugaucauggacaagaagcuuuggaaucugcucauguuugcuuaauaaaugcaacggcuacaggaacugaaauucuuaaaaacuuggugcugccagguaaggugacaccugugauugcauucucggugacuucuuuagucucugauacagagguagaucuucuuaggcugacaggguggcuuaguggcugguuacuugcuguuaggccugacaaguugaauuuggucugugcagccuguauugguuggucucugaccuccucaugugugcauggcacaugugcgcucacauucaaacaguaaauauaagagcaagcaaacaaagaaaaaaaaaaaccuaaaacaugucugugacuauacuuugucucccuagguauuggaucauuuacaauuauugauggaaaucuggucagcggagaagaugcuggaaacaaguaugucugucuuugaaaauauaagccugguagagaaggcagagcacucaggaugaggccugagcaguuuuaaccuugugacuggguguuagauaauggugaagaagugacuaaagucgaagugcuaagacagggucuggcaagccggccgauagcagaugggcucauguuacucagggucuggcaagccggccgauagcagauggggcucacugucacccagggucugucacugucuuuacugcugucagacaaaacaauagucauuuuucucuuaccugugaguucugagugcuuucuaaguccuggcguuaauuccuuaguguuagugaagaguaugauuggauugggggauuauaggaauaagaaaaugaauucaguuccaacgcuuggaaggcagaggccgcuuggaaggcagaggccgguggaucucauuaaauucaagaccagccgucagcuagagcuaaaaaaaugagaccuugucuuuaaaaaaaggaauaagggcuggagagaugucucagggguuaagagcacugacugcucuucugaagguacugaguucaaaucccagcaaccacauagcugcucacaaccacccguaaugagaucugaugcccucuucuggugugucugaagacagcuacaguguacuuacauaauaauaaagcuuugggccggagugagcagagguccugaguucaauuccuagcaaccacaagaugucucaaaccaucaucuauacagcuacaguguacucauauacauaaaauaaauaaauauaucuuuuaaagaaauuuuaaaaaaggaauaagaacaauaucuuucauuuauaucuucuuagucugauauauuucuuauugugcuauaaugcuaaauaaaaaugccccauaugaccuauguuuuguuuuuuacauauagucauacuuugauuuuucagaacauuuccaaauuugauuucguacuuacuguuuuaaagugguuagagucuaggaaucucucauuacauuuguccauaaacaagaaguaaauauuaauucaaggaaaaucaggauuuaguucauauuuccuuugauauguuuucuuuggagcauaguauauuuaugcuaucuacagcauaacucuuuuauugguaucuauaaaauaauaaaaguucuauuauuguugcuuaccuugcugacucugcaggaugguuuaagaauaauacaaucauuacuuuguacuaacacuaaggaguuuuuuuuucuuacggaaccaugugcuuuugccacaaaauugugcccuggcucucaucagcagccacaguaugggccuuugggacgugaccagaguaugugugggaggaagucugaaugaaucuuuuauaauuucuugcaaaagcaaaucguucacuacagcauuucccaggugucugcagaacauugguuauaggaaauguuaauagccauuaaauggaacaguggauuucauggucaaacgaguuuggggaaugggucaaagagguuucuguaaaccucuuuacuauaaagcguucuuuugagguacauuaggacuuuccagggaggagauaggccaugugguguuuucucguucuugggacucuuuucucucagcgcaugcugugaaguggugccauagaggacgcugauuuacccaccccuuccuucaaggagacuuaacaucagcuguggacauaguguuuguggggauagcucagugguagagugcaguaaaacacacauuuguuuucccuuuugaaugcaaggugcacacuauuauaaauguuaaacaacuuuugcuuuauagccauauaaaucuuggcuuuuuucuauccccuucagcuuuuuccuucaaaaaagcaguauuggcaagguaagcaguccgugacugaguaugguggugugugagcaucuaauagugccacuauaccuuggccgcuaaaaaaguuuugacuuucaaagaucuuauucucugagggaaaaguggguuuagcucacuuucuaaucugguaacucucuugguaguuuaagaacuuagaguacugcgacuuuacacuguccuuuauuagagacucgagugacauugauguucaguggauagaguacugugguagaaauuaguaaguggaguuaaccagaaaguuuuuuuuuuuuuaauacaucaaaugaaaaccuuaguuuuuaaacuacacacgcacaugcacacacgcacacgcacacacacacagacacuuuuguauuucaaaugaaagcuguguuacauucugaauggaguugagcuugcuuuagugauuggccacucuuguguagguagacagggucugaacgggauucagcacagcccugcuugcugccugguuuucucuuucgucugaucagaaaagucaagggcaaauaacguggucauuuaacaacucuauaagugauagcuuaguucaaccugaguaacguucuacuuggaccucaguuaaaucaugagaaggagaauugucacauccaugcauggaauuuggaaaguuucacauugaguuuuucuuaaucuguaaguguggggaucacauuguagccaagcacuuucuaaaucaaaucaaaugcuuugucuuugaaaagaaccgagcucaagcugccauggaauucuuacaagaacuaaauagcgaugucucuggaaguuuuguggaagagguauaauacauauauauauacauuauuauuuuuuugcuacaguguguuuuaaaaaauuauucaaaacccuaaaacuuagaauucugaauuuuugugucauuuauauuuaguuggaauuuaauuugucaacuaauuuauauuaaaauagcuuauguguuucugccauguuuaauaugugaaacuguugaauuuuuuccuccccuugucuuauuuagaguccagaaaaccuucuagacaaugauccuucauuuuucuguagguuuacuauugugguugcaacucagcuucuugaaagguaaauuuucgauguuaauauuuuucauggucuugcuugguuuacauaguuuucuauguacaucuuucuguauacauauuuugucuuguuucuaaaauucuuaaagaagcuuuucauuugaaacucuuguauggggaauaaaaaguuagauauuuggauauguuuagaguaacuuaagugaacauuagcuauugcuaagugaugaaagauuaauuagaagccagguaugguaguauucacugcagucuaauccaucacccaggagccagagagagaggaucaggaguuggaggcuagccuggccuacacaauaaguuucaggauaucgaggcuagccuggccuacacaaugaguuucaggacagcuugagcugcguagugagcuccaguguuucugaaacaccaaaaccaagaaaaguaaaauaaagcaguuccgugguuacaggaggauuuguaggugucuauggguuuuggaaauguuccacuaugaugaaaauguuuagauaguguguucaucagcauucuuccuaguacuacagacugggguuucucaucccucgagugcagcacuugugagguuguugccccaugaaaucacuugcuuuccacuguguucuugccuguuuauguuagacaguucccgugucuggcauauacuugcuggcuuauguucuuacuuugccuucuuuuucaguacauugcugcguuuagcagauguucucuggaauucccagaucccucuuuugaucuguaggacauauggacuaguugguuauaugaggauuauuauaaaagaacacccagguaaaauuguuaagcauaugggacuugcuaaugguuacuugagcaguaauuuuagaaacuugcuaauuuaggaagucacaauuuuuaaauuguuuugaauuaugaaauaaauuucuagcaguacagguucaaaaaggcaauaagauucaauaguuuuuuuaugugcuuacuuauuuauauguguauugauguuuugccugcauguaugacuguguaccaaguguauaugagugccuacagaguccaaaagaggaccucuuaucacccagaacugggcuuacagaugguugugaaccaccaugucagugcugggacuugaaccuggauucucuggaagaguaaccacugcucuuaaccauuaagccaucucuagccugauucaaaggguuuugacuauuuccuuacauagcuuuauaaauggaugcaggccagagacauaacauacaccuuguuugucuugcuaagagacccaggagcuauguaaauaccugguuucuuuugcuccccaacccaaaauaggacaucuaugguugccacaggagugugugggccacuuugacacaaacacuacaucagugguucucagccuucccuuuaauacaauuccucauguugugaugaccccuagccauaaaauuauuuuguugcuacuucauaguugcauagcuguaauuauagcacagcauacauaguaacauacagaauaaaaguaauaauuuugccucuccauuacaccaccauuucccaccugucuuuauuuucagucuuauauuggccuuagauuucuccauuccacguccaguuacauaugauaagccuuuuuccgagcuacuauuccuaaggaaacaguguuaaaggaaaccagugauucauaggcaggccuacagcagcccagagcugauaucagcuuguacuauagaaucuuaaucuuagaauuuuauaaaauuuuccuuuaguauucaguaaaaaugcuucuacuaaauaaaguguuuucauucuaagccagcuauuauaugaaccaggcacucuguugguguaacaguggcuauuaacacugaagccucacaaggcuuagugucaugugggcaguuaggauacacuuuugguagaugacgucaggccauuuaagaguuaaaagugggaagcaaugggauaacauuuguguuuuaaguugaucgcucuaauguuagaguaugaguagagaaugaguggacuuaaaggagccaaguuugcaggggugcgaugggagugagguaaagaagggaggagggagagggugagagccuccaacuuaggggagaugcucaggagugggugaugaugaaggucagcacuguuagcugugugucugcucugauguaaaugacuuauuuacucuuuacagaaccuuauuaagcagauacuauuaucucugcacagaaauauaauuguuacuugucuaaagugacauagcaaguggcagacuuauaaccucauuacaaauacuaauugaaguugugcauuguuuuguaucccucauguggaaagcaguguccaaagucagaucaggaagugggaguaacugacauugaguaaaagaagcagucgaggcuagagugagacccugucucaagaaaaaaaaguauagguuuccagccuggugcguugggucaugccuguaacgacaacaaccaggaugaugagacagaaggauugccaugaguucaaggcuagccugggcuauagaguaagacuccauuuccaaccauccaauuacacaaaauugugugugugugugugugugucuuacguuccuauaaugaaguaaagaauuaucuuuugggauugcuugacaguaauagaaucucauccagauaaugcauuggaggaucuacgacuagauaagccauuuccugaacugagagaacaucuucagucuuaugacuuggaccauauggaaaaaaagguuagugugugugugugugugugugugugugugugugugugugugugugugugugugugugugugugucuaugugugugugugugugugugugucugugugugugugucugugugugugugugugugugugucuauguguguguguguaugucuaugucucucuguguguguguguguguguguauguguguguaugucuaugucugugugucuguguguguguguguguaugucuaugucuguguguguaugucuaugucuguguguguguguguguguguguguguguguguguguguauuuuuacagaaaccuaugcaugcaccuguggaggccagaggucaaccucagguucucuuaguugcuuucuacuuuguauuuugagacagugucucaucagucuagagcuagccauucaucuaugauuggccaaugagauccaggaucugccugccuugaccuuaugcacugagguuccagcuuauagccaugucuggcacacauuuuacucacagagcuacuccacagccacucagaaaccauuucuaaaaccaguuuuauuaaaccaguucauuugccuguuuauuacuucauguggauuagaagauaauuauaaauauugaaaauaagaugguaugugaagaguuaauauuaacuaauacugcuauuuucuucaauuuguguuucuauuuuaggaccauagccauacuccauggauugugaucauagcuaaauauuuagcacagugguauaaugaaguauguacuuuuuguuuuuuaauuaaauuacuauuauuuccaagaugugauaagggauuucuuuagaggguuaugggagguuaauguuuucccuugugaggauguaaugcaagugggagcuuuucaguugaagucuagcuaucacucuuucaguacugauauuuuaauuaacaaauaggaauuuuaguaaauuucacccagaaugaauguaaagaaauggucuacaauuacacuuuccaaauuaagcaagccucuguuucagugauuuuauaauggggaaaccaugggacacccaauuuccauauuuugaguuuugauaacuagaucuuuaaauauuuuaaucaauuuagacaaauggacggauuccuaaaaguuauaaagaaaaagaggacuucagagauuugauaagacaagguaauuuucugcauuguaauuaaguauuauauaaagcauauaagguauuaaauauugaaaaagaauugcuugaaaccaauauuuauugucagaugaugcugucaugaguuccuauuuuacuuucccuggggguaaagguaucauuucuuaaagaguuuaagaagcacuugagaggcauacccaggugaguucgaggccagccuggucugcagagugaguucuaggacagccaggguuacacagagaaacccugucucaaaaauaaaaaaaauuaaaaaaaaaaagaguuuaggaagaacaaauggcuguguuuccuguaaggguuagcacugugguccucuguucagcuccugauaagauuuuucuauaauguuggaagccaaagugaaaggagacauuguuagcuauuucuuguuuuaauagggauuuuaaagaaugaaaauggagcuccagaagacgaagagaauuuugaagaagccaucaaaaaugugaacacagcacuaaauacaacucagguaucaaagaaacugcugaaaccacuguguuuucugauguuuucauaugugaaaguugauauaacaauuuaaccuaauauugccuaaaugccuaaacaaagaauguuuggguucuuuuguuuuguuuuuuauuaagacaaggucuuuuuauguagcccaggcuacuuucaaauuugcuguauagaccaggcugguuuugaacuugugacacuuuuccugccuccaccucucaaguguuacaaguaugugccaugcccagcggaaaacagcaguuuaguuuuaauaaaguuuuguuuuuuuuuguuuuuuuuuguuuuugguuuuucgagacaggguuucucugucuagcucuggcuguccuggaacucacuuuguagaccaggauggccuugaacucagaaauccuccugccucugccucccgagugcugggauuaaaggcgugcgccaccacgcccggcuuuaauaaaguuuugugcccugcaugguggugaaugccuguaccuccaccccugggggaggggagcaaggugaugaguagccauccuuggccacauagcaagugcagaaacagcuggggcucaaaacaaaaaaaaaaucuauauuauccucauuaaaauuaugucugugcuucagcauauaauagcaauaaaauaaaguaauuucuuucacuuagagaaauaugauuuaugaauaguugagaauuuggagguaagacuuacaaaugauaguuugcuagucaaaagaaguacuaaacucaaaaguuaaauuuuguuaucuugcauuuuuuugcagcaguuauuuagacauaauuggagauguucucaaugacuuguacauugcaaaaauuauaagcugauaugguaacuuacaccuguaauccuggcacuuuggaggcugaggcagguggauucugaaucugaggccugaagccagccugggcuacagagugagguuaagcccaacuuagaauacauaaaaaguaucggaaaauaagucagacuacuacuacuacuguugcugcuguugcugcugcugcugcuucuuuuucuuccuccuccuccuccuucucuuccuccuccuccuccugcuccuccuccugcuccuccuccuccuccuccuccuccugcuccuccugcuccuccugcuccuccuccuccugcuccuccuccuccuccuucuccuccugcuccuccugcuccuccuccuccuccuccuccuccuccuccuccuccucuucuucuucuucuucuucuucuucuucuucuaaguuuguucguucauuuuugaggaacuguggaauaagacaccuggaagauuuuuuauaguuuuuuuuuuucuuuuuuuuacaauuuauagcuugaguacugccuuucacauuaggaaagcacucaagucacuguagacauuuugaagacccugaaaugguuccugaguguaugccuuguaaaucauucuagcuaaggaacaucuuuuaucuuaauuggaaagaauguugaaaauguauauguauagcuaucaaaugauacauguuagaucugcauuuuuacugaaaauaaaauguaaugaucaguuuuuaaaacuaaaggaugauuauaaagccaggcauggcggcauguacuuguaaugccagaaccaaggagauggaggaagaggcuugagaccacauuggcugcauagugaguucuaguccagucugggcacaagaaaaauaaaacagaaaaaugguucuaggaguugggggcaguaaauugaacaauuggauauuaauguaugaacaaaguuagaaugugaggaggcaagaaggggucuggguauuggauaggguguaccuagggggcaguguuagagagggagcugggaaggaggaaaaggccugagugaagugccacccagaggucuguugcaugagcugcucaagcagagggcacgggcgcagggcacagaguuaaaggaucaguaggaaagucaguacgauugaaggggaaagaaagugauaggcaagauuugaguuuggagagcuagaaagggccauaccauagcagaaucucgcagaccuagaaggguuuugagcagggaaguaggaaggucuguuugauguugagacaggaucucacuguauauagugcuagcuggccuggaacucauuaguagaccagguggccuggagcucacacagauucaccugccucugccuucuagugcugagauuaaagaugugugccacuacagugggccauucaaaagacuguugacucuuaugaauacaguagaggugugggguuggaagccaagacaccagucacgagguugucacugagaacucuauuuugucugcauagaaucaaagccuauaguuuguaaaguuauuaguguggugaccuugugaguuucaaauugcauaauuacuuauuuuuuguuagaguggucaucucugaacagcccuggaauuagggugaaugaauuucaggacuuucauaagcugggaaaccaugaacagcuuuaaaucuggcuuuguagcaaugucaguagucauuguugucuucagauacaaaguauauagaaugacauguuuggcuuuuccuuuacuccauguggauaugggagacuugucugaaaugcuaacaggccaggagaggauuuucuuccauucucuuucccaucagaucuccaucagaaucugauuguaaauaaaacuaaauacaucagaaguugauauuuuacugcacuuugaaaauauaaaggacuuauuugaagaaauagcauugaaaauaaagguggacagcauucuuaauguaaguaaugucuuguguuccuuuguuagaucccaagcaguauugaagauauauuuaaugaugaucgaugcauaaauaucaccaaacagguaacaacaagaagggaaaauaaagcugucuucaacuccagcucagaauacacaccuuuauaguaguuuuuucuuauuuuuuuagacaccaacuuuuuggauucuagcucgugccuuaaaggaauuuguggccaaggagggucaaggaaauuuaccuguccgaggcacaauuccugauaugauugcagauucaaacaaauacauaaaacugcagaauguguaagugucuuuuaguugugguuauuuuguuuguuuuucaaaacaggguuuuuguguguagccuuggcuguccuaaaauuagcuuuguagacaaggcuagccuugaauucagugggguuaaaggaaugugccaccaugccuuaucacuguuuuuaaacuauguguaacaggcuacuuaaaucugcccuccuaaagggacucagacccugguuucugacagaggaccuaaaaaaaauguuacaugaacaacucaccuucuugaaguuaaguccaaggaaaaccacacacuucaaaccuacccaauaguauaagucaugaaaaacuuuguuuaauaucuaguuauauuugacuguaaaaaugacuaguauuaaugcugagucucucccagguaagggcacaccuuuuagggugaagguuguacuauugggauugaaccuggguccucauauauaugugaagcaagaguucuaccucugagcaaugucccuaaagucaccauuaguuucugucuucaguuguccuuugccaaauuuucaguauuauaacucauagauuaggacaacaaaccaagauuuguuaaacacugaccaagaucuucucuguauggcaaccuuuggcccuggaggaaaccaggucagguuccuugcauucaucagcucuguacauuaguuacaaagaagguaacauccagggagaccugaccuuacggguccaugugugucagaggagguauacuggauaacagguguuuaucuacagucauugauuccuuaaguuacgagagauuaaugaccaaaagaaaaugacucaaaagaaagacucccacgagugucaccuggguacauugaaguuggaugcuguagggaugacaggugucaccuggguacauugaaguuggaugcuguagggauggcaggugucaccuggguacauugaaguuggaugcuguagggaugacaggugucaccuggguacauugaaguuggaugcuguagggaugacaggugucaccuggguacauugaaguuggaugcuguagggauggauaaugggagcuuuggcuuuagaggacuccagaagaggacucuacugccagcucuuccaugacaccuaacuggugagaggugcuacuggugauaauucucuaccauuuucacauuucauauguuuccaaacauuuuuaaauuaaaaauaaacuuuuguucacuuaaagaugacuuuagcuuugcuaauuuuaggagucauuaauuguaggguuuuguuguugucaaucuuuuccaguuaccgagagaaagcaaagaaagaugcugcugcuguaggcaaucacguugccaaauugcuucagucuguuggccagguaaguggugaacaguacuucuccccgcagcaaggagcucagccagggagggguuagagagggaaggcggggcccuggcuugcuucuuuggcagaagugccuacuugucucuaaugagcaccccuguuacaggagaacaguuguguuuggaguguuuucccagcucuuggcuuugugcugugccauugcugucucugugugugugcgugcuagagaaaaaccugcauuuauuucuuuauaggcaccagaguccauuucagagaaagaauuaaaauugcuuuguaaguccuuuuaauuuucuuauuuugcuuaauaaaaguaugcuacagaggguguucuugggaguuuuaaaugguugaaauucuugaaguaggguguguguauccuuagguaaauuuuauuuuguuuuuuuguacucuaaaggacauuuuaagacugggccauugguacucauuugaucuguguuaagugacuaauggaauuaagaauuugucaugauaguucauggcugggcuucugggguuuucucccuaauuucugaggcgguaaaagcguguucuuggagucaguugcagguugaagauagcucagcggguuaagugcuugccaugcaaacagauccugucucaaaaagauagguggaaaacaaauaaaaacaaaaagaaaaagaauacaguggcgauucauagaagacacucagaaucaaucucuggucaccacauauucaccacauauucacggguggcuaagcauauccaugcauauaucacacacagaaguaaaaguuucauaaaguuaguugccggguuagaaagauggccuaucaguuaaucggaggaaccccaaagaacagguacauggacacacacauuuguuuuaagccuuccucacacaccaaacugagacuauaaccaaggcagcaauuucuucauaccauuaauauucggugucuaacaaaacccccacaguacuguggucacucaauaaaauuuuuaaugaauaaaugcuucaaaauguuuauuguuuuuaaauuguuuguuuguuuuggguuuuucaagacaggguuucucuguauagcccugacuguccuggaacucacucuguagaccaggcuggccucgaacucagaaaucugccugccucugccucccaagugcugggauuaaaggcgugcgccaccacacccagcuauguguaugugccuaucuguguguggauaugugcaccugcagaggucaaagaugucagauccccuuggagcuagaguuauaaguagucaugaggccugcugugggcagguggguacugggaacugaacucaguuccucuccauuaacagcaagcucuccuagcugcugauccaucuuguagcccuaauuucuuguucauaaagugacccauaauuugguguauucaguugucacaaccuuccugaagucuuuacuguuuccaggcagcaauucugcauuucuucgagugguaagaugucgaucuuuagcugaagaguauggcuuggauacagucaacaaagaugaaauuaguaaguauaacaaccagaugcuaaguuaaaagauacuaauaaaauguguauaauagugcugaauaaauggugcuauaaaaauaaugugaauauuucauagauuaccugaaugauuuuaauuuacauauauuauucagaaauaaauacauaaaaauguguuuagauuacugacugcauugugugcuauauagaacuaacauuaucauguuucuaccuugguagagacuccagcuaggagucuauaagaccccuuguguuacaccuuaauguauuuauuucuuauuuauaauuuuauacuuuauuuuaauaaaauauuuaauauuuuuugcuaauauuauuuuguauccugaaacuugaguaugaauucagccuuuuguugcuuguguauguuaucuaguuuuacugauuuuuuuuuuuuccuuucaguuucuagcauggacaauccggauaaugagauaguccuguaccugauguugcgggcuguugaucgauuucauaaacagcauggcagauacccagguaagaacagcaguugauuuaccagauacaaagaagaucuuuuggcuuuuuuguuguuuuaagacaggaucuuacuuauuagcuugggcuggccuugaauuugugaucuuccucaaucagucuccaaaguauugaauuuacaggcaugagccaucagauucacucauuaaagucuuaaauaaaugcuugacuugaugccagguguaguggcacuugcuuuuaaucccagcacuagaggcagagcugggccaagucuacagagugaguuccaggacagccagggcuauguagagagaauaugucucaaaaaagaccaaccaaccacacaggaaaacccacuugaccugaauuuuaguauucuguggauauuagaggaacuauuauuugauuuuuuuuuaaaaaagauuguuuguguauuuuauauacauauuuuuauauacauacauacauacauacauacauacauacauacauacacacacacacacacacacacacaugccagaggagggacucugauccuauuacauggucgugagccaccaugugguugcuaggaauuaaacucaggaccucuggaagaguagccagugcucuuaaccucugagccaucucuccagcccagugcucuauuguuuuuuaaggcucacuacuuuuaaaccauuugauucuaaacuguuagagaagaauguugguugaauguguaucacuaacauguccuuguauguuuuuucuuuuuucaauuuugaagauuuauuuauuuuauguaugugaguacacuguagcugucuucagacacaccagaagaggacaucagaucccauuacagaugguugugagccaccacgugguugcugggaauugaacucaggaccuuuggaagagcagucagugcucuuaauugcugaacugacucuccaguccuaucucuugugucuuauuuuuauauuugucuuuuuaaaauucauuguguguguguguguguguguguaggucucaaaaacuuagugguuuaaaacagguuaaagugugugugcaugaguguauacaugugugcauguauguguggggaccagagguuaauauuaaaugucuucuucaguugcuguucacauuaucuuuugaggaaagguuuuucaaugaacugagggcucacagauuuggcuagccuggcuggccaagcaggguccuccugucuuuggguuuccccugauaagauagauguauaccauuaugcucagguuugaaugcggguucucggggauugaagugggcuccucaggcuuguacagcacaguuuacccacugacccaucuguuggccuuuaauccucucugcugguuucuuguuggagcugaagcaguuccuuuuuuaagagggagguucuuagucguauggugccuaggcuugagauucugaagguuugacugaguuaaauaucgaagagacaucuucacucuccuuacugagaugcuugacaccuggguaugguggcucacagcuauggggcggacggacauucaggaggcugagguagaaagauugcugugaaucugaggucagcugggcugcagaaugagacuuugucccaaacaacaaagaagagagaaagaaaugacguaggacuggcuuaguggcccuagcacuccuaaggcccuggauuagauuuccugcaugagaaaacaacaacaaaaugcuugucuuguauucuaguuuugcuguucaugaacuaaguaauuugucugugucccagcuuuucuaucuguauaguuguggcuccuucauaaaguucuuuugagaauuaaaucagugcaaaggcacaaaguacauaaaauaguauccagcaucuauuaauguuuaguaaauguuguauauuacgauugcuuuauguccucagugccauuuaaucacucaaaauggaaauaaagggcuggaaauggaaauaaguagcuuaguuuguuguugagugaacaaagcccuagguuuagagaucuucagcacugaaaaaagcauacgccuguuaucucacccaggagguagagucaggagaauuagaaguucagggucaccccugacuacauacaaguuugagacuagcagggauuaauaauaagacuuuguuuccaaaaaaauagaaauuuaacuuaaaggauauaaguaagguauuuucucuuuaauuuuuugaucaaauaauuauugaguauuuuuuguguuaaucuucuacaacauaauuagcuaagacuuaaaagaccagaaacccaccagaauguugggauaauaugcugucacuaaguuaaaaucccuagaccugaguaagacuuacugaacuucaauuugugauagauuuuaguuuagcagauucugauauuuucaaauguugguuuauguuuguucuguaguuuuauaccuuacuguuuuaaacuggauuaaguaagagauaacgaucaguuugaauuacuuuuuccccugagaccuggcgccuaugcagcccuggcagucuuagcacucacuacguaauacagagcauucacaaacacagagaucugccugccuuugccuccugaguuaaaggugugcacuauugugcccagcccacauauuuauuuuaauggaaauguauauauuauauauauauauauauauauauauacacacacacacacuuuuuuuuaggaguaucuaacuaucaaguugaagaagauauagggaaguugaaguccugucuuacuggcuuccuucaggaauaugggcugucuguaauggugaaagacgauuauguccaugaauugugaguauucuuuagagcauauaaagauaauacucacugggagagacugugaugagacuaauaaaacuguaaacccccauccuuucuguaguugccgguacggagcugcugagccacacaccauugcugcguuccugggaggugaguuuuguagaugaaaugacuuauuuguuaucauacaguuacuauuuguuguaauuaguguaauuagugcuuugcccuccacacugcucuccuugcccgccagcucccgugccaucagagcgagcgacucuggagucuuuaguccuucugaagaccuucuuccgaucaugagccucacuuagcucucuggguacaaggacacauaggccuuccuccucuuccuccccuuccuccucccccucgaauccuccugccccaucaguucuaggaaacaaaggcuaacuugacuaaaaggcccuacgucccuucuuuuccugagacaugcccuaggucuuugcaccucagggcccagugaaaaccugccauuucuuucauaaaacucccuuuaucacuuugcucuaguuuaguuagacacuguaacuguaccauagauuggaccuuauaaacaucagaaauguauuucuuacggguuucaaagauucagaugccagcauagugagaggcuguagagaucucacugccugucucauucauggugguuuucucacuuugcucucacauauaaaaagaaaccugcaggaucuccuuuauaagggcaugaaucuauuugugcagguucuaaucacuucccagaagccccaccuaauaccauugcacggaguguccacauguuaaugacagggagaaggaguacaaacaugaagcaaauaauaccuuuuuaaaaaugacucuccugccuauugccucccauagccugagcugugugcuuaugaucgauuccuuucuagacguugaaggcagauccaguuugaggaguagucuguucagaaugcugcuagugauggaguccuaagaaaacuguacuuuaagcaaacacaaauuaaagccugauucuggauaauuuauguaaauaaaaucauucuuucaugucuaaauaguaaauucauaggaaagggcaaauuauuacuuauuuacauaggccagauucuaagagacacaaucagagaggccuaacgaguguagguaggucuuuaguuuuauguguuuuguuaugauuaugaacguaauucucugaggcuuccccuauauaaacaugagccauuccucuguacuaguccuucuuuucuucuuuaucauagcacaaagucuucuacauacuauaugcuguauuuauuuguaagcuauccuuucucuugcuguuaaacagaaagacccaagguagcaagcagcagaucuuuuuguuucuugcaccucugcuacaucuauggugccugagagauuuggugauaguacagguuuaaguccacagccucaguauguagaaagaagcugccucaguuuagaaaagauucuuuuuuucuugguggaauuucacugucucuuuguguuucaaguaccuuacaggagcucuguaguauucaguguggguuugacccugaauaauaauaauuauuaucuuuuauuuuguuaugacucaaaauauguuuguuugggauuuuaaacagcuuggcuuuauguuuuuuguuuguuuugucuuuuguacucaucuguaucugugguguauucuauauagcauagaucucauauacaccaggcugaccuccaauuccauuuguaacucagacuggccaugagcucauaaucaucuugccucuacauccccagucugaugaauagagucauccguuaccaccacacccaacucuuuuuuuuuuuuuuuuugagacaagugucuucacuguauauccuuggccagccuagaacacacuauguugagcaggcuggcuuugaacucacagagauccaccagucuuugucuccuuaguacugggauuaaaagcaugcaccgucaggcccagucugguauauauuacuuaacucuuaaaauuuauucuuuucaaacauuuacuucucuccuuuuuccaacaggagcugcugcucaagaaguuaucaaaauaaucaccaaacaauucguaauuuuuaauaauacuuauauuuauagugguaugucacaaacuucugcaacuuuccaguuguagaauaagcaccauguguaauauguuaaugguuggaacuguaauugucuucauauugugcuuugguuuguaaaaaucuguuaaaggacggaaguuaaauuguuuccuuaauaaaaguuuuucucauuuguaau

SEQ ID NO: 12154 - RNA, 136853 nt, Mus musculus
agcgccgcugagcaagaccugcgcugccggacugcccgggccccaggcggcugcugcacgagggacccccgaguccccccaacccguggcuggcaggcccagggauugugcggguggcugcgcuccggggguaccgccaggugaguagccaggauggauggagcuccccggggacuugcgcgugugcggggacccuagagcuggcaccgcguuggguggggacugcgccggagcccaagagggcgcgggcagggcuggggugcgcgauccgggcagguggccgggugugcccuggggaacccuugcuuagggacagccgggcccggcccagccgccggccacuuccucuccuggggcuggcgccaccucuccagggugagcaguggccaacuaggguuugaaugagagacgcggcuccgggugcugggguggccgaagcgucuaccucgccaccgagaguccuacgcgggagccgcgucccugcuugcggggacuugauuuugaacaguacuucccaguaguacacagguggcuccgggguggggcggagcagcucuuucuccacacgcgauucugggacccgccccucccgcaauucaguucaguuuggggaucucaaagaggucauuugccucgcggggagccagaauucgaagggaagguggguuguauccggaccuaggagguugauaccuggaaagucaggagcaggcccuguccguacccugaucucgaacuguugagagagaggcuggcagggcgaggggccgacacgcccuggaaacagguggcuuucucucugagaccuaaauuugaauuucaguuccauuuaugugacacagcacacagagaggagcccccccacccccaccccccgaguccagguuucucucuugggucccguacuagaccagagccuguuuuccggggcaucaaagagacucccugcaguuccugacccugguggcaaaggcccuuccuggugggcacaggucauggccccugcucuuugcuucugcgggacacuuacaggauguuggggucgggacuagcccuaggcuguuacccauuuugcacgguugugggcagcaguguagcagucccaggggauuuuggcuguggauuuuuauugaugcuuaaaauuacucggugcuuggccucccaggcaaggcggcgugugugggguacucugaaggagccccagcggggacccuuuugcaccuccugggcgaaguuggugggaaguuacuggugggaaaacuucugcaaauaauuaauuucgaaaauaggcaacccucucccugcccugucuccgcaaaagggcuuuucuguuucaacuaacagaguggacccauucauaugucuugucccauccucucucauuggcccccucuagauuuacaagcaaugcuuucgagauauauauauauauauauaucacuaauaacauuuauauuauaacucauuaauuuguaaguuucuuuuuuuuuaaaucaaaauagcucacaaaucucccaagaucaaaauuggcgugugauaauuuauaaauccacucuuuuccguagcuucuguacauuuuaaauuuuuuaaaauuauuuuugagacaaucucauuauauaguucagguuagccuugaacuucugaucuuccuguguccaccucccaagugcugggaugaucagugugugccaauacucuuggccuguaggggaugcccuccccccaccccuccccaccccaccccccaccccccaccccccaaccccccuuccccccguaccccccccccguaucccccaccgcccacuucccagagaugaggagcccaaguguuucugguuuuaugguccuguaaggaucuuuccggaugucucauuuugcacaagagugcuugcuggaucaacuuuauacuuuagaggugcuuaccagugcccuuaaaaaaaaaaaaaagucaacccuguuuucacuuccacguguacagguggacauuguugguucuuggauuggaccuucccaugcuuuuaggaugaccgucaaaugaaccccgauaucccuggugcagugggaagggcaggcaauauucaaggguucagcugguccaaagucuaguagaauucuuccuuggguuuuuggcugaaauccagcacugacccacaugugcagagacuguucaagagauggauagucccuguuuccuguuuugggguucuugugugugagaaguugguuucaaagugugaaggacauagaaacgugaaaaaaaaaaaaaaaaagaaaagaaagaaaagagguuucuucccagcaccaccagccauguuuguacugacuaugugaguugaucagguuacccauaguagggguggagggaaggggaguccaggcuaauucauucauuuuggaaagaacaaaacagaagcaaagagggaguuaucuugauggcuagggcccugcucugggaauacagucagcuggaggagaccuucuugccuugggcguuggagcuuggaauacucugccugaacuggccacugccuggugcccuguccagaaucuguuuccagugugguguugcuucagggcuugggaucuugcugggggaaaccuuuccugggcaucuaacagugagaaacaguggggaugccaggauggagcauucuguauagugcagaacugugcaacggggaccuggaucuuccacuuuguaagcugggugaccuuggacaagccagucccccuacccacucuucaaagagucggccaguuuuguuggcauauggccaaguacugccagcauucugaauucacaaaaagcaagcccugaaaggaucagaaucauaugacugucugucugucugucugucugucugugugaccuuggucauauaauuuccuccucucuggauggauuuugauuuuuaaagcugucagcuuuucucccucuucccccggugcuaggaauugaacucaggacuuggcucuuguugggcagaugcucuaccccugagcuguauucccaggcauggcauguauuggucuauaagguaccugaggguaaaccggugucaugucuagagaguuuuauaauaacagcuacuuuccagggggccuuugcuucugucccguccccccccaacgaugaacuagccuggaaacuccccucucucaucuccaguggcuagccugcuuaacugauagugucaauauaaauagcgcguuuggcauggguagcucccaaguggacaggagagcuaagaguguauauauaucuugugaggucacauccuggcuuguguugaagccuguuccccaggcuagaugacuguuccucuaccagcuuuucacucuguagcgcaggcuggccuuggauucuuagcaacccuccugccucagccuccccaagugcuaggauuauagcugggugcccuguuguguguuuuuaucucauuuucacagggucuaguauaagucaaguuggccuuaacuguggaugaccuuggacuucugauuuucuucuccccaccucucuuguguugggcuuauggucuauggccaccaaacucucucauguggcacugagaaccaaacaugcuaggcaagcauucuauccaccgagccucacccccagugccucaucuuuuuaccaagauggaacucagaagccuuccuuccucagcugauuucucuugaguccuuuaggccucagguggggggagggaggcagaggagggggagggggagggggagggagagggugguauuacaccuggcucugcacugcuguuucuucccaagccauaggcagggaacagguggagacaaugccuccccauggccagcucucccaccuaggagccuuucugccuuccuucgagcaaagggcaaggucugagccucucccuguucgcugacauuugcauccuaguucccagcccaagcagaguugauacucagagcuccgaucaccuggcugauggauagauaagcauccaucagucaguguuuaguuccccaaaucacaccauccauaccucaggguauuuuguccucauuuugcaagugacaggguugagguucagagcaaauugccuagagacugagcagauuggaggcccccacaguccuaguccaaggccugccucucacuuccuguucuuuggccuggguggaauagcuuucuagugcugcuugguaauccugguggauacaaugacaacugugggaccuggcaggaggagcugagguugucacacaguuccacugagcacccucuuaguugauuuuaaaaaaaccauauuuauuuacuuauuaguauuuacuauauauuguuauaugugauacuaugcaauauaauuaauuauauuauuuauuuauguacauugguagguuugcuuuugccuaugucuguaugaguuugucagauccccuggaucuggaguuaagcaauacaguugugagcugccaugugggugcugggaauugagcccggggccucuagaagagcagccagugcucuuaacugcuaagccauccucuccagccccuaaguugacuuuuuuuuaauuaaaaaaaauauauaugaauauuuuccugcauauauguauuguaucaugcgugugugccugguaccugaggaggucaacagaggguaucagacccccuggagcuggaguuugguggucuuaagcugccugacauggggguggggacaaaauccugaucccuugcaagagcaacaagugcucuuaacugcugagccaucucuccacucaacucuuucucuccuauuuuuuugagauacugucuuguguagcccaggguagccccuaacuuacuacguagcugagguucuacacuccgcuuccaugcauuaccacagcugacuugugcccuuguuuuaggggccugggaugcauagauuauuuuauuuaggucuuacaaagucuucaggaggcugguaacauugccguccuuugcauggcuggaaaugaggucgaaaggguguggugucuagguacaggugcaccuaucuccgcauccagcaggcucaaggggcuuugagcugagaagugaugagauugaguuugcguucugaaaugcugccagccacugggcugagaaccucaggggcucggggcaagaagcuggguacagcagagagcuccucggaggagccagggagagggaagaaugcuuggauucugaauuugcccguuguuuuggggguaugagaacguccagacaauggcugggauacucgcuuaagcacuaacugcccguaggagggcgcugcuccaaagacacuuggguacucugcuuugcuguacacgggaggcugaggguugcccucugggcuuaggaaucccuugaggagggauggaauggaagcagagguguggagaagccaccauuaguaggggggcugccaggccuggacauuuucuaccuuuuuggucucauuguuaugcagaagaaccagcuguucucauuuuuuguuauaaauggaugguuaggcucuagcagguuagauacggugcuggagagagguuaccgagccugucagaacggcuuugcuuauucaaauuuggacaagaagagaggguggagauuugguuauucaaagucugucuagcgguggggagggucaaggaggccaauagccccccucccccaucuccacccagacuuuauuuaaaccugcgcucucuaaguggccaagggcucucagcacuagaaccuucaccuauaacuucaccuauaacagggucuuggcuacugacacuccagucacacacccaccucaguucauuaaagccaguucacucuuuuaucccccccccccccccagccuccaucuuucuccugcuucucccgucucccuggagcggcugacaaugaccaccauggucaacguggacacccuuccagaauaugagaagagucagaucaagagagcgcuggaguuagggacggugaugaccguguucaacgcccgcaaauccaccccagagcggaggacaguacagaugaucauggagacucggcagguggcauggagcaagaccgcagacaagauugaaggcuuccguaaguacuugcugggcagagcagcgggguccauaagcccugcugccuaccagaguagcaucugcucauucacccugcuuuauuuaaacccgucugucaggaugaguguugauuugguccauucuucuuuuaaagauuuauuuuaugaguacacugucguugucuuuagacccuccagaagagagcaucagaucucguuacagaugggugugagccaccgugugguugcugggaauugaacucaggaccccuggaagagcagucagugcucuuaaccacugagcuggcucuccagccucauuugguuccacuuugugugggugggggcggggugagguugagaucaggugggggaaguugauccagggaaguucuugugaaacgacagcaaccccaguuggucaacuuggcccugauagugaaacagaaguggggaucaccuggucccaaagguagcgagcugucugacuucugacaggccuggggaggcugggggcuuaguagccaaacgccuaacgauuuauuuauuuuguugcaaaccacagcagcaaggagcucuguguuuaaagguacagggaaggagaaaaaaaaaaaaucaguuacuguuugcagccuucagaugaaauucugguccugguggcugugccuucucuagucaccuuauacugggcuguuggcucaguucugggacuuucugaggagauuguagcaaacagaguuuucaguugcagaugugugcuuuaauuugauuucuuaccaauuagcgugaguuuguuugaaguuuauuuguucauuuaagugugcaugugugggugcgugcacgcucauagcauucguaugagggucaggguggggcacuugugggaguugccucuccccuauguguggauucuggggacagaacucaggcuaucugguuuggccacaagcaccuucacccacugaggugaucuugcccgcccucuuuguuuuagaagggucucauguagcccaggcuagccuggaacuuggaaaguagcugaggaugacuuucaaccggcgaucucccugcuuuuagcucucagagcuggggagagaggugugcaccucaacacugcuauguauguauuuauuuauuuuuaugcugggccaggaauggaacccagcguuugugcauaauagacaagcacucugccaaaugagcuauguccccagguccguacugaaaagcucacaugauuuuuccuuacaguaauuucuuuacuuguguguauguuauggcaugcgugcacaggucagaggacaacuuauaggaguugauccucuccucuuaccauguggggccuggggaaucaaacuuaagucgucuggcuugguggcgagugccuuuucccauggagcccucguggcaggucccugacuagcuuuucauagaaaaauuauaauguacuuuugaaauagcagugcuaggaguugaggcgggaggauuguggguucacuguggccacauagugagaccuugccuuaaaaaugaaguacugugagaagcuagagaauuaacucacaagugccuuucaccucugacccucucuucaccuguauccugcauaagcgcugaccuagcuuguucucuguugcuguauauauaccaugaccaauggcaaauaggaggaaaagauuuauuucaguuuacaggcuacagcccaucuuugaggaaagccagggcaggaacucaaagcagaagugaggagacaccauggggguagaacgcggcuuaccaauuugccuugcuaucucuggcuugcucggcuaguuuuccuaggaugacaccgcccauggugggcugggcccuuuuacuucuauuagccaucaagaaaaugucccacagacagggccacagggcaaucugauagaggcaauuacuuuccccaggugacucugggauggagaggcuuuacagcugaagcuaaggguggccagcucauuagucguuuagucuucugguaauagucugccuucaugugacaggugugucuuaaauauuucauauaaccucugcuccuugguuucuuuucaccuggggcugguuccuuaucagcacacguugaucugccucuugcuuucacgggccuggcugcaccguggcaguuuaacccggagugggacgugugcuguucccugccauuugucaggaacugcagcaguggguuuuugcagucuucuuaaaaaguaagucauguuuuuauugaaacaagaucgacuuaacacacaguuuaugguucaaagagacccugcaaagccgggugugguaacucaaaccaguaaucccagccucuggagguugaggcaggauuagaggauuauggauugaagagaaucuugagccagguagaguggcaugcgccuuuaaucccagcgcuugggaggcaaaggcuggcagaucucugugagguagaggccagcuuuucuacauagugaauucuaggacagcaggguuauguagggagacccuagagagagacggagggaggaacagagagagagggaggaagggagagggagggaaagggagggagaggaagggagagagagagaugcugagcuacaaaagccaggcaugguggcagacaccugugaucucagggcuggccagccaggguaaugacaaucggugaggugcagguucagugagggauccugacucagaauauaaggcagggagcagcgaggagacaccagucacugccauccacuugcaagcgcagagcacauuuaaucauuuguuagcaucagcauggucaguucugguacacuuucaguaaguggcacuuaccucgucccacugacccccuuccuccaucacuccccccccccaaccgccccccccccccagcccugaaucuacuuucuguuucuacaaaugccauuuauagaaggcuguguuguggccauuucauggacagggaaucguaauuuuggcuuuugcauguggcuucuuucugcuucgugucuuagaauuuauccacauuuuagugagaaacagaauuugauuccuuaagauauccaggcaauacgcuacaggaaauuagucuauuugcuaauuuuaggucauuuaucuguuuucccgucucuuaucuaauccgaagagcgugguucugagcauuugugugcagguuuuuaaaauuuauccugguauaugugugcgcaccuucgugaguucaugugcauguguguucagguccccaugggcaccugagggucacuugaugugggcgcugggaauugaaccuagauccucugcaagagcagucagugcucuuaaccacagagagagccuucucuccauuccugguguagagguuuugauguagguccuugcgcugccccccaccuucaccccccucccgccccugugcuuaaugugaaauuuaggugucauaugcagugugugugggaugcuguccuugcuuucuuucugcauacaagcuguaggcgccucaugccaggguacgguguguuuccgccuuauagggggaaguuggugucacuccacaaaagcagcagcuuuacuuugcauuggagccucgaggucuguccccacaccuucuccugcacugccacugacuucugugcuuguccauucacuggucaagcugagcgauucugcauaguccuuccucccuuccucccuuccucuuucccucccucccuuccuugcuuucgauuuauuuauuuuauguauaugaauacacuguagcugucuucagacacaccaggagagugcgguccaaucacauugcagaugguugugagccaccacgugguugcugggaaucgaacucaggaccuauggaugagcagccagugcucuugaccacuggcccaucuauccagcccucugcauaguucuuaauaauuuuuuuuuguuuuuguuuuucgagacaggguuucucuguauaucccuggcuguccuggaacucacuuuguagaccagacuggccucgaacucagaaauccgccugcuucugccacccgagugcugggauuaaaggcgugcgccaccacgacaggcaaaaaaccuuuuuuuuuaggaaacaauucauuaucacaaucucucucugucuccaucucuuucugacuguuucugucuaucugucucccauucuguguguguguguguguguguguguguguguguguguguguguaugacacaaccuguuacugccucuuuccuucucaaccuacuuuaguuuggagauagcucugccagguaccuaacagagcucuggcaguugcuaaauacuauguaaaucuccuggagcccacagcguccugcuggggaccagcaggcgcuugccuucuguuagcuuggccuuuccauguuugcauagcuuuaucuguauugguugccacugcacgugcuauggcugggagugaggaugaggagucucaucaggggagcucuccugccccacagcaucugauaacccccccccccaugcuccuccucugauuccugcauccuuuacaguagaaggaagacucacugcuaguagaagagcugccuuguguggagagugaggggcaggaugugccagccggccagugaggauggcacauuggaggaggcacugugggagccacagaugcaaaugagcagauugugggucagaucuggagaggguucaguugggucauuguggccuagccagagggacuugaugggagugcuuagcuaucgugguuuggggucgaguggugaugaugaugaugauggugguggugaugaugaagaugguggugguggugguggugaugaugaugaugauggugguggugguggugguggugacauugaggcugauugugauuauugugguggugaugguguugauugguggugguggugcugaugauggugcugaucgugaugguggugguggugcugcugauggucugauugugaugguggugguagugauugauggaggaggugguggaagagacuguagugauaaggaugauggugccaguugugaugguguuggugacgaugaugauggugaugauguucaugagagacagcuaauguucagugugugaguaaacauagccugggugagagauugcgaagucagucuucaugaugauuaaacaguaggaauuacacccgugaugaggaggauuacguccugggggaccaggugacaugucacacaguacaggaauaggcuggagggcuuaaaucuuccugcuguguugucacugucuucaucacuagcucaagcaugcuuucucagucuguaggcagcauaaguuuccggcuggaacccagaauggugaucucgggugauugccacagcagggggaaagaccacaauccccguaugcagaagccacuccguugagugccuggaugugugggaagacuggauggaggaugagugggaaccuaaucaagugugcaaauggguccauucuuggauguuguacugguuugguuuaugucaauuugacaaaagcuaacguugucugagugaagggaaucucaacugagaaaaugccuccauaagauugggccguaacaaggcuauugauugcuucucacaaacuuauggcuagccccaguugcugaagucaacaccuauauaacucauugaacuuggagaaauugaacuggugccuaccagaguuaguugucacugguucugcugacuaguguucauggugcuggcagguauccuucaugcuauccgagaggaaaggcaaacauuaacccagucacaaauccuuugaucuaccauggcuaucugccuaaaagauacacagguguaauagcggcacaaaaguuguaggcguaaccaaccaauaucuggauuuaaugagauggaauccaagccugauacgguuuggguggcuaagaaucugagacuagauagaccacggaccuaggguaaaacaaaauacuacuguucugcuaaaggaauguagcaaaaaaugagccccucuaacaacauucugcuguacucacagauaaaugucucucuuggccauuggcagagaaucuuucuccugccauagaugggaacaaauagagagacccacaaguggucaauaugcagagugaggacucugggaccucagaccuccguggaggucucuaucaaaugccuccucucagggcuuaggaacucucuggaauaagaggaagagagauuguaagagccacaggggauggaagacaccaaagaaacaaggccuucuagacauggaggaaggagugccacucauaggaacgcagagagacuggcggcaggcacagagccugcacugaucugaacccugugugaggucccagggcugagaggggacguggaugcaaaucccacccucaacccagaagacaucuccaauucauaacuccucacaaaggagaaaugauuuuucuccaacauaaucucacuggguauacaaaccacacuuaaugauaggccccguacccaauaguugauggucaucauaaaaugugugguauuuuugggguugguuuuguuucauaaugcucugucugggcccuguuuuguuuuuguuuuguuuuguuugguguuuuuuuuuguuuuuuauuuuuguuuuuauuuuaaaccuuacaggucuuuuacuuauauguuaugguuucugauuuuuguuuuuauggauuuucuguguguuugccaauguauguaucucuguaucucuguguguuucuuaucuaucuaucuaucuaucuaucuaucuaucuaucuaccuaccuauuuauuugagacaggguuucucuguguagcccuggcugucuuggaacucacccuguagaccaggcuggccuugaacucagagaucugccugccucucccucccgagugcugggauuaaaggcgugugcugucuauuuuauguuaauuaacucauuaguuaauuauuauugcuuguuuguuuucuaauacaagagaaagcaagguguggaugugggugggcggguagggucugggaguaguugcuggaggggaaacuguaaugggaauauauuguauggaaaaguauauuuucaaaagcaaaaauuaaugaaguugaaaaaaaaaaucaggcuguaagcaagcauuuucuuaauuagugauugaugugggagggccagucuaugcaggggcucuaagagagaaggcugagcaugccaugaggagcaagcuaguaggagcaagcagcaccccuccauggccucugcgucagcuccugccuccccgcuccugcccugcuugaguuucucccuuggcuuucccuaacagacugugauucgggauauauaagccaaagaacuucucuccuaccugagcggcucuucucuugcuguucuuucagacagagaggaaacugcagaggaccugggaggucguagcuggaagcuuccuuucuagaauaaccuuccuuuuugcgcaugcagugccccucucuggggugccccuucuguaucggagcagcugaacaacggaugcuguuggcguuuugguuuuggcggugguguccuggguuuugcugacggugggggcuuguuuggccuugauagucugagggacuuucuuccauccuaaguaaugauugccguggcugucaagcaaauacgcaaagaggaccugagcuucgucacgcugccugguacuugugccuuggcuuacagaugagacuggacagugaugaucccuagagacccaaggaacucucaccggggcuuggagcuugccacauaggccacguuggcuggucagugagaucuggggcucuucacucacuugaccuccccagugcugggauugcaaguguccgccaggacauaggcauuuguaugcagggauugaguuuggguccuggcacuaacgcagcaaagcgcuuugccacagagccagcuccgaaagguaguagucuuuggugaauccuuuuggaaagaacuuguccccaccaccugucuacauugagcgugagcagggguuacaccccagagacaaccgagcccugugccacugugaacgaaacuaagaugcccugaugccaacugcccugcuugugggcaguguugggcuucagugccacgccuuacucugcaauguggcuuugggaggaaggagacagucuguuuagaggggagaguccaacccccccccaauuuaucuagacaguaaaccaagcaggaaaaggaccuacauguacccuugauucccaagguuugucccugaauauaucaguauguggguuucagacacagacaggcagugacucugagcugugcggcucuucacccacgcaaugugauucuguuucggccuccccgacaccccugacuucucucccuccguucuuccuuuccuuuucuucccuuccucuccugagucuuucucuacaguucaugguggcccuaaagcuguagagcaagcaucuucugcuucugucccacuuugaugcugggauuacaggcaugugccaccacacauaccuucugggacuucaguuuucuuauugguauugacagcagagcauauuuguccccaggguaucauggggcugacuuugugaauguuuguaacagggccgauggaggguucuucauagggugucucucagccucucagauagguggcugaaacacuaggucacuagcagguaccagugugugucauauguccgccuccugcuccucuguggccaaauccaggguccugccagagcuggccuaggaugugaggcugugcgcugacgggcagccuggcuccuugccuccucccuuccacaggccaggggaacccgggcuguucuggguuuacaggaguggugugcgcaggcuguggcugguucugcagacagcuccagguggggucaauuuagugcauaucucugcagcagcaagagggacuggggagcugcagcuugcacuucuaaguggaguugguggucaugggugggcagacauuuuuggggugugugugugaagugcuggugugaaggagucugugcugagaaagaagaacaugggaacuuaaguaaucuguagaaaagaaaguagcaacauuggcuuagcagaaggaggggcuagccagcacuccaccucccagaggggaggaggaggagggaggagaaggagggaggaggaggaggaggaggggggggaggaggaggagggagaggaggaggagggagaggaggaggagggagaggaggaggagggagaggaggaggagaagguggggagacucggucaggaacugaggucucucugguuucugcagcaucugcagacuggcuugcugcaagccucaccgagccaggagagucauccagacugacuguguggggaagggucgugucucugagauacaagaaguaccaggccugguaucuugaggguuuacuguggaaauagaccucagaguggucccucuccucggcuuuaucauucccaagugaaacaaaccaaacccaccccaaaggauccugcuguagagacgauucgagaaugcacccaugaaugcauuuaaaacuauaacugggcgagaacacacccuugguucuccaccugggagaaauguaaucagaugcccaaaccaaaccccucuuguucguuuguugguuuccuuucaaaauguaagaucuagaugugcuuuuacagaucuagaaaaugcuaccuuuuaucauauacuccagauacgccccuuuucauuuucuggcuauuugguugcauaauuaugaauuaguuuacauauugaauaugagauggaaggcaauguagcauaugcucuaugcuggagagcagagcuuagccaggcccgaggacacuggguucucucccccuggccugcugucccagcuguucaggaggaucauagguucaaggccugccugggcuacggagcgagcucuaagcugggacaaggaucuuuaauccuugcacuugggagauggaggcaggaggaucugaucagcuacacaggaaguucuugaggcagccugggcuacccaagacccuucuucccuuccucucaaaguaaaacaaaacaagaaagacaaaagacaccguaaaugcaaggucagccugggcagccauagcaagguugucucaaaaaaaaaaaaaaaaaaaaaaaaaguguguguuugggcagaaucacagcuugggcuggcaagauggcucaguggauaaagggacuguugucaaaugugacaacaugagguauggugggaugagagaaccaguuuccccaggcugcucucugcucucuacuuguauaccauggcauaccuguaugccacaggcaugcacacaaaauaaauaauaugaaugggaggaguggcugagcaccugccuagcacccuugagauucuagagcuaaucggugcguaggaagaaaaggaaagugguucgagaccugacuggcugccuuucuuggcuccucgguuuaagagauucugucauugggcuuguuguucccaucuguaaaaugggauguuuugaugcccacccgugugaugucagggggauuagaggagugagauauuagggaaguuagauaugucccacccacuucaugagcuagugcuugauaagaagauacuauugaggucucagcaauaagucuguaaaguccgcucccaggagaagcuuuaaacccuggaaccuuugaaugucuugcccuaccuggugaaaggcucuucguagaggggauuaugggauggauuuugagaugugauccuggagcuaggacugauguagucacaaggguucguagaggugugagggucaaagugugagagggagacguagaugguauuuuguuggcuuugaggaaaggggucacacgccaaggaaugcaggcuguuucuaaacacuagaggcaccgugggaacuaauuucugagccuucacaaagaaccgguccugcucagagcugugagauuaaaaacuugaguuguagggccgggcgugguggcgcacgccuuuagucccaacacuugggaggcagaggcaggugaauuucugaguucgaggccagccuggucuacagagugaguuccaggacagccagggcuacacagagaaacccugucucgaaaaacaaacaacaacaaaaaaaaacaaacaaacaaaaaaaacaaaaaaaggaaaaaacaacuugaggugucuucaccugcucguuacagcagaauggaagcuccuguguucucuugaccaguguggauaaguuggacugcuggcuuugagccuuuccuauucuuaugaagucaaauaaaaguacagcuaggucuuucuugcacauauccucuaaaaagccguauggugauucaguagugaccaucugcauaguaguguaauccgagcccuugggaagcagaggcaggaagaucaaggcaaguuuaaggccagcuuagucuacauagucccaggucagccagugcuacauaguaacaucccgucucauccaaaggaaacuuuaauagacaacaaacacguauuuugucuaugaaaaacaaaacaaaacaaaaacaaaaacaaaaaacccuguaauauguagcccucaaacaauuugcauuuuguucugugucuggggauauuuuuaauguacauauuagaggcuuuaguaguaaaucuuuuuauguucgugugugugugugugugugugugugugugugcgcgugugcauggagucagaggaauggguuuauuuauuuauuggacuuggggggggggugaguuccuuacuuucuuuuuuuuuaagauuuauuuauuuauuauauguaaguacacuguagcugucuucagacaccccaaaagaggucaucagaucucguuacggaugguugugagcuaccaugugguugcugggauuugaacucaggaccuuccgaagaacagucagugcacuuaaccacugagccauuuccucagcaacuccccccacccaguuacuuucuacuguguuucuugaggcagagucucucacugaaccuggcugauucagugaggcuggcugccugugagcagcagggcuccuccagucucccugucccuggcagaggccguucaccaacccaaccccaccccaccccaccccacccuuaucugaugauaacugaauucagauccuucagaugauuccguggcaagaacucuauuugcugaggccucucccagcucccugacacuuuaaacauaauucucucgacuaaugcauuugcuagaccuggcuuuccaguuuuugguaguuugaaucugcccuacaucagucuuccucccauguuguuugaaauuagucccguguuuaagguuuguuucuucaacgggugucugcuuuuuggguuuuuauguuaucccauguuuuccuauaucaaauauuguuucugggaacuuuuuuuuuuuuuuaauagcuaaacuuaggcaaauucucugugguuuucacuggauagauuucuaaacacagcuguguggugggcuuggaugauguggucaguuuuccuaaggagacucuagcuucugucccgcucccgccccaucauccacucucaccaggaugcaggcuucagccuuuagaggccugcaguggagcagcagaaacugugcuugcugcagucagguguggcaaggcuuucuucccgccugcgggcuguuuguucuggcccaggcccgccaagccaaaccucaggacugagcaggcugcuuuuggcuggagggcugcggaggcugccucagcaccagcuagauggaauggaggaugggggaacuuuggagccuuuuccuguguggcugaggcggccagcccagccuuucuuucacuccacaugucaggucugggaaguaguaugcuuuuccagucuccucagggcgagaggucugguuugagggaaaucaggaagucccggguggggguaggcaugaagauccaagugcagcccucagcaucuaagugaaacaguugggugguuuggcacgauguuugcuauccaugcgcuggggaggggagcagagauggauuccugggacuugcugaucagcauccuuuccaagcauguaggcaaucccacuccaucccgcuccccgccaggcaucuccccuugggaacuucaucagguaagcuccaggggagagaaacgagguguguaguuccugaagaacagcaccugaguucuggcuuuggcaugacuauguacauguauguacauaugugaacauacgugaugguuaguuuuaugugauucuuuuuuauuacaucuuuauuuguuuugugugugugugugugugugugugugugugugugguguguguguauaugcaaaucugccauggcaagugugaaaaggucagagggugacuugggggaauuuguuuucucccccucucugggaucgaacucggguccucaggcuugguggcaggcagcuuuaccugcugagccacaucacuggccuguggggggaguuuuuguuguuaacccaaugaggguuggucugggaaggaaagggcuucucugaaggugggccacaccccagcacugaaagggaaggugugauggagcgagcugacagugcaacugucugucugcagcuccugccacucagguccuccucucacagagcgacuguggccgggaucugugagcgaauagaaacucccccucaacaaaacugaaacuuagacaguaugcaaagaugcuguacacauagaguaaggccugaacgacuuucugacgggggugggguagguaggugggugggggggaggggaugugguuccaaagacagggccaugcagaguugccaaggagagcugacgggagugggugguuccguguggcuguguccucacuggugcacaggggaagcuuaauaaaugcagacguuagaucauaacccccccccccccccauuccuccauuccuccagcucggacugaacaucuucucugucccuuaaacuaccacugaauuuuuuuuuuuuuuuacauuuacuuagcauguguguguguguauguauguauguguauguauauguauguauauguguguguauguguguguggauguauauauguguguauguagguguguauguagguguguguguaggaguauauauguguguauguagguuguguguagguguauauauguguguauguagguguguguguguagguguauauauguguguauguggauguguguauauguagggauauguguguauagguguguguauguguagguguguguauguguagguguguguguguagguguguauguagguguguguguguguuuauguguguauauagauauguguauauguagggguauguguguguguguguguguguagguguguauaugugggugugugcauguguaggugcuaaggugugcauguggaaaucugagaacaaauuaggaaaguuauuuuucucuucucauuuucacguagguccuggggaucaaacuuaggugugcagaguuagcagccgcugaauuuauaugaugaauuuauaugaugaauuuauaugaugaauuuauaugaugaauuuauaugaucuugcuggcucuacuuuacuguugcuagagaaauuuauagauugcuauugauccccuuucuuacauauauacaaugcauuuuggucauaacuaccccauuaccccucuuacucccuccagaccuccccccccaacuuccuguucucuccuuuuccucauuuucauugccucacugagauuugguucccaugccacggaauucacucagccgaguguacaguucagguagugaaucacacuuuguuugugggguguuuuuuuuuguuuuguuuuuuguuuuuaagacaggguuucucuguguagcccuggcuacccuggaaucgcucuguagaccaggcugaguccugcaaacacaaucauagcuaauuuuagaacauuuugaauccuuucuccuuuggagucccuuagcucuggugucauuucuccuucccaguguuggugacaagugucucuaacgugucugcccacuggacauuucguauaaggaaaucauccagcaugugaccuuuuuuguuuguuuguuuuguuuuguuuuguuuuguuuuguuuuguuuuccgagacaggguuucucuguauagcccuggcuguccuggaacucacucuguagaccaggcuggccuugaacucagaaauccgccugccuuugccucccaagugcugggguuaaaggcaugugccuccacugucggugcaugugaucuuuugcccccuccuacuuccuugacagcacuugcuacuaaauuacuuucgacuguagcuguccuaggaggggugaugcugugucccacugugguucugauucgcauuuugcugguuguugguuguucucuuguaaauagaauuuguucuaguagccaggcuuggccgugaggccggccuuuugucaucccugcuacacagaagccugaggugggaggcucacaagggucaggcucaucugggcuagggaguucuaacuaguaaguucaaggcuaggcuggacaucuuagaaagauccuauuucaaauacuguaagcgcugggcagguucagugagagaccuugccucuaagauagauagauagauagauagauaguaggagcuacugaggaacacauccuagggugagugucuggguaucaggucuccacaggcgucugaauggacaagcaccuucuaccucccagccccacccccacuaaacauagaugacauacccuuacacagauacauuuuaaaaugggcuggggauauagcucagugauagaguggcagauacuaagccauggggucaggcuucagucccuaccaccucaaauaacuuauuauaugauauuuuuguuuuuguuguuauuuuguuuuuguuuuguuuuguugugauaggguuucucuguguaacagagcccugguuguccugggcucacuuaguagaccaggcuggccccaaacucacagagauccaccugccucugccucugucuccugagugcugggauuaaaggcgugugcuaccaugcccagcuauuauacaaguuuuguuuuguuuuguuuuguuuuuuugguguuuuugagacagcguuucucuguguaguccuggcuguccuggaacucacuuuguagaccaggcuggccucgaacucagaaauccaccugccucugccucccgagugcugggauuaaaggugugcgccaccacgcccggcuuacacaaguuuuaaaaucaacaggcuuucuggcuaaaccagugcuuauggcaggggaauugucuuuuuauuuucaucuuuuugagcuccagggcggccaucuuucgcagauguggugcucaugacagauuugaugagaauauucuggaagucugagcacagagcacauggacgugagcagggaacagugaagcaugaguucugggcuggggagaugccucccuggguaaagugcuugcugcacacaagugaggaccugaguucagaucgccagaacucacugggcacaguagccuguaaucgaucacaguguuuugggcaugagaugggagaugaagaccagaagcucacaggcuagcccugcuagcuuuggaguacagcugagaacaagagacucuuagagauggaaggccaggauggaugccagagguuguccucugaccucuguacguggucgguggugcagauagagagaaggagaggaugugagucccugcuggagucuagagaaauucccuacgucucuuguuucuuuuguuuguugcugggaaguaagcucagaaccuuauauaugcugggcaagggcucugcuucagagcuauaagaaguccuugccuuauaucugaucuuuuaggggacaaaagaacccccccccacguguguguguguguguguguguguguguguguguguguguuauagacucuccuccugccacgguaucuguguuuugugacccuauauacugcauaucuguaugaccaaagaugucuaccuacuacuuccuaaaugucccacacccccaaguuccuuugccugccauuugaucagugucucaagaaaauggcagaaaggguguguccugggugcugggacaugggugcucuuaagaaguugauggagcagcugucacgggucagcuucccucugugcaccuguaaccaugugauguguauggauauuccugaguaaugugcagguaucacccccagccugugacucucuuacccauuuuacugauccauaaagugaucuugagggacccaacaaacucaccaggcugucuggggaacuacagcagacaguugucccuagucaccuugugucccaaaccuuuagauuaagagauagaaaaagacaaacuccaggcugggaaagaauguugacaaaacacagugacaaaggaccuguauccaaaacaaggaguuuuaaaacccaacagaggacaggcaacccaauuaaaagugggccaaagaccugaccucccuuccugcucccauccaccucccugccuuccauccuguugaagccgcacgaagcugcuucugggccagcgaggcucagaugaccccagaguaggucauguauguaguuuaaacacugcuaguuaacacauuaaaaaaaagauuagaaguaguaaaugaaacuaaauauguuauauuuaauuuaguauaacgaagguguuauuuuaacauauguacuauaauucaugaaacauuaaauuaaaaguauuauuuuauacauacgaguguuuuucuuaugugucuauaugggcaccaugugugugccuccugccugcagaggucagaagagggcaucagcuaccccgugacuguaguuacagaugguuaugaaccguuaacguaagugcugggaaucgaaccagggacucugcgagagcaacaggugcuacuaaccauugaaccaucucucuagcccugagacaguuaaccuuuuuuuuuuuuuuaagauuuauuuauuuuauacauaugacuguuuugucuguaugugugucuguguaccacaugcaugccuggugcccacggaggucagaagauccuuggaacuggaguuacggaugguugugaucuacaauuugcauucugcaaaccaaacccugauccuaugcaagaguagcaagugaucuuaaccacggagccaucccuccugucccauuaacauuuuacauuauuguuuugggugucuaacucuuccacugauuauguuuguucgguuuuuguuuuuguuuuugagucaggggucuaauuuaguaacucaugauggccuacaacucgguauucuucuuagugcugggauuacaggcauguguaaucacaccuauuguguguguguacagguguguauguauggguuugugugagugcauguacagguguguguguguguguguguguguguguacagguguguauguacagguuugugugagugcauguacaggugugugugugugugugugcauguacguauauguguguguguguguacagguguguauguacagguuugugugagugcauguacagguguguguguguguguguguuuguguguacaggcguguacagguguguauguacagguuugugugaguguauguacagguguguguguguguguguguguguguguguguaugugcauguacguauauguguguaggaaucuauguugaugcaagcaagccuuaguguguguuuggaggucagaggauaaccuaaagggaucaauucuuugcucccgucaguggguucuggagaucaacccaggaugucagguuugacuccaaguaucuuuuacccacugagccaugucaccagccccaguuuuacuguuuaacuggccccucagcgcacagugccuucuucuguugucccuucuuucuucuucuuuuauauauauauauauauauauauauauauauauauauauauauauauauaugauauuuucuuuauuugcauuucaaauguuaauccccuuuccugguuucccucccuccggaaacccccuaucacauccucccucccccugcuucuaugaggguguuccuccaccuacccaccuacucucaccuccccacccucaauuccccuacacuggggcaucuauagagccuucauaggaccaagcaccaccccucccacuaaugcaugacaaggcuguccucuguuacauaugcagcuggagccauguguacuccuuuguugaugucuuaaucccugggaguucuuggggggcgggucugguugguugauauuguuguucuucuuaugggguugcaaaccccuuuaauuccuucgguccuuucucuaauuccucuauuggggacccugugcucaguccaaugauuggcugcgaacaucugccucuguauuuguaaggcucuggcagggccucucaggagacagcuguaucaggcuccuuucagcaugcacuucuuggcauccacaauaauuucuuugcuucuuuacaucacacacuuauccauugacuagccaucacuucaccaccaaggagcuaggaacuguugaguugaacacaugguauagguauagugcgccuuacccuuccuucguuggugacaagcaagcagacaccgugaguucaccauagugaaaaugaaggugauugcugcugcuuuagggggacccugggaaguuucauaccuuucgcaggaaagugucagcaaaaugguggcacagcgauaccuaccugaugugccaguaggaacaccagagaccugggguaugaaccauugggcucagcacucugucugaguauuuccauugucaggaccauccuuagaggauaguuuugcuucuuugggauccagggcaaggugaguguucauguuggucacccuggagaagagagaauaugaucuugggucuaagaacaaacuggagaugguaucaauuuucuugugcagcauaguaaaacccaucaaauaacaggcucagaacaaccccuuggugggcgaagauuucaggagggaucaaugggcaggugugccuguguuucaacugauguuggcugaaagcccucacccagacauagucugcugaaggcugggguggaagauaugugacaguagaagcugugggucauucugccauguccucucaugaacuagacagggcugccauguccucucagucaaaccaaucacaggggugguucucaugguggagacuguggucacugggagcagcucaccaggccuugacuuugguguuuugggacugucuagaagacagugcuaaggaccuucaugaugggagagagugucugguggggaucugggagcccggugccaaucaguagugguagcuggcgugucuuguccuuuauguggccucucccucugcagcaguccagugggcuuucuugaaugguaggcucaaggaucgguguuccuaggagguagacagagggccucaagguuucuugaggucugggcucugaguuacaguaucacuuuuguccucuaauggcgaaaguggguagcagagcugaggaguucugguggcgucgguaaggcgguagcagccuagccuuguguuccgguggcuccugguggccuccuuguccacugcugaccugggaggugcugucuacccgcaucucguggggcuuugaaguggucuuggauccugggucagguuuuuggggguuuuuuguuguuguuguugcuaaugacagccucaguaaacaaucagcucagagaaguuuccaggccucaccuggccuucaagacacugauauauguggacaaucagagaaggugccaugaaucuuuucucauuacuuuuacuuuauuuuacuuuguuuuauuuauuuauuuuuuuugagacaggguuucucuguguagcccuggcuguccuggaacucacucuguagaccaggcuguccucgaacucagaaaucugccugccucugccucucaagugcugggauuaaaggcaugcaccaccacuaccuggcuuuauuuuauuuuuuaaaguuuucauauaauauaguuugagcauauucccccucccccuauuccuucuagauccuccuuacuuccuacccaccccgacucuuauguucuuucucucccucuuugaaacaaauacagaaugcuuuuuuaaaaaaauuaauuacuuuuuuuuaauaugcgaugugcacauuuguaugaauggcugugugugccugugucacagcaggcgggagggcacuugaugcccuuucccgugauucaccuucacuguugcugucugccuuagucucacugagccaagagcuugugguuuguugacuaaacugcuggccggugggucgcagccaucuuucuguuuuuguccauuacccuguccgucuucuaguucuaagguuauaaagugcggccaagccuggcuucuuaugucuacucuggggaucugaacacaagucuucacgcccuuugagccgucuccccagccuucuuguuuugagacaggauccgaguuaucccaggcaggcuuugaaagcguuaacucagcuaaggagccgauucuccugccucuuccucccuagugcugggguuacaggcaugcacuaccaugcggugcugaggaucaucaaauccagggucuugugcaugcuaggccagcccucuaccaacugaaccauauguguuucauauguuuauugagaauacacccugugucugaccagggcagguaagccuuguuggaccguuggucuugugacccuguguucuuggcagacaugggggcuugcaugaggccuagaagcugagaggaaauggaagucccauguugggagggagggagggagggagggagaaagagaccuggcugucaucuccuuucugguccuuccucucaugggaccuaggcuccagcacuuccucucuguggcuggcaugccuggccugcucuuugaggguugcaacaucugcuucucagggcuguugugaggauggaggaguguccgugcucucagcgauuaccacagcccucugagccucagggcuucucaucagggaggcccuuucugccugagagggcccaaggcucaguuacucuguacuucagucuccugccugccccacuguuugucucuuuccuucucuuugggauuuggucaucccauaauuacacauuuguaugggcagauguuucccuccuccagucggcucuuggaagggugauuuguugcuucugcuguucuaaaaccucacaugaccagcgcauuccaggcacaugauaugcacugagcagguggaggcuguaucccucccugccccugcuccccuggccucggggacaccuaucugccgacgugacguggugcucuauguguucagcaaggguuauguuuccagaagccucugcgggccugaggagagccaggccagagccaacuagccaggaacacccuuccuuagaugugggaggcuuggccggcgcuguggguagaggaaauguuuagaauggguugugugaggauggccccuugccuugaguuuccaaggaaacucugggcugcccaaaccaucucucuggcucaggggagcacugacaagaagaggagcguuaugggagugaguguuuaaguggcuuuuugcuggugaaacacuuaauucuuuuuuuuuccuucccauuuucauauauauguguguuguaugugaguaugugugaguccacacguguguaggcaugugcacauguguguguaaguucaugcagggguccagaguuggugcugagaauugcucucagcuauaggcuagcuaacgggagugaggcugccuucccccuugcuggggagcaccccaggaucugaagacacacucaugaaggaguuugggaacaccaccauucccgccuauaaaacggggcacaaugugaaccccacuuuaucagauugcuguggggacggaguaaguuaagaucugagggaccagauugugcacagcccuggugcacaugcuaacuguguggcagcuggcgacaguggcauaaugguuuuuaaucuauggccgugcaguaaaccaccccaaacuguaauggaggcuguagagaaaccaggccuuuaagguaaccaguaagggcugcgagcagggcaaugacacacucagcuccuugcugccaggggaucgaggcagccugacuacugucauauugcauggcccacacauuaucagagccucgcuccuccacccugccacauagccccauuccucuacuuugaucacgcagcacauauuaacuaagccugcuuccugugauguaaggucuccccuucacucaggggagaccuugaaaagcaggcacccaggcagaaauucuccucuagaggccuccuuauggacucuuguagacacccggaaaucucuugcccgagagaugguuugauucagcaucucuugcucucaaacucccucccuucuucugcccuaaaaccagacaggaggaugugcgaacgagcaucauguuggagcugccaaccuggaguuuugcagccuucggggauggcucuguggcuuccucugggucccggguucugggcagucacugccuguucugggauggcuggaguuuguuuucagaugggcccugauguucuaaugggcuuggugaggcuuugcuagcuguuauacacccugccugugcugggcuggcccuccagacuuucauuugagccccaggaaguggcuguguagagaaaagcacagaggagggugggggagcuaugggucacuggugcgcaaaaccccaaaauagaucaucuucuaagucgccaagcccgggggggcggggagggggcagccgcagaugcuuuacauaaucuccuacccagaaggaaaggguuuuucuuuucuuuuuuuuuuuuuuguuuuuuguuuauuuguuuguuuguuuuguuuuuuugaacaaaagaauccccaaggaacuugaaaauaucccgguguuugguucagagcaucacaaaaugagagccagagaggcucagguucaaauccccaaccuaccauuugcaagccgugugacuuggucugagccacaaugaugaagaagaugagagcagaccuuccaguauguaugaagcgcagcuuacguuguauuugauacaugguggauaggcuguguggaguuucccugucucucuuccauuuucuuuucuccucuccucuugguccuggacuuguacuugguuccugguagcuucaucauugcggcuggcagggaggagaugggacaaauaucuccucucuugcaggccacuggccugggagggaagguugcaggcaugaauagucacuucuguaaccuccucccccagacccccaaaaccugugagccugagaugcuccuuggcucaggcugugcguacaggcaagugaggcucacugagcggggagaggcuccugagcuaugaagguagauccagugugcucaagaggccuggugacaagcagaucaggugagccauggcauagggacaggaagagaggguggaguggguacagaaugggacuguguaucaaggaaucugggcuagguuuguagcucagcacagugcuugucuuacacauauaaagaaaagaaggaccagacuaugggucuccugagccucagggaguagccaggcuccgagcgccccugauuucagcccaacaagaagccauaggguaugugggacuuugugguaguguggagaggcagagacagggugcugagguuguucagugcuugcuagguaacucaauugcuggucaaaucuugguauuucugcaccauacccccccgacuugaacagucuauucucugaggcccaagugucugguguucugaagcuaauccuguaggcaggcuuguauggccacguagcagaguccugugguuaagcuagcaccugcugcagaacuguuucuuugagcugguggcaggcucuauauuagccagguucuacauuguucugucugccaccagcugccuuacccagccggggucagggucagggugagcugaggguagggguguggagagggugcucuugggguaaugucucguuuuuuuuuuuuccccucugugguaugagcuucaaguuguaaaguucuugccgaguguggugacaaauguaaucccaacacccagggacuuugaggccagcaugggccccagguuagucugggcuacagaagaagaccuaguuuuaaaaagaaggguuggggcuggggaggagauggcucaguaggcaaggugcucacauuggaagugucaggacugggauuuagaucgauagcacuuucauacaugcugagcagcggaugagugugguggucugccuguaauuccugggcucagagguggagagagguccucaaugcaagcugcuggcuagacuagcuguccuugcaagcucuguguucaacugaaagauccugccucagugaauaagguguggagugacagaggaaaaugccuaacaucuggcguccuugcacacacacacacacacacacacacacacacacacacacacacuauacauauaugcaaaagaacaggagggaaggucuggggaucucagugggugaaguguuuguuauccaagcaugagaaccugagcucagaucccaacacccacauaaaaaagcccgccacggugucacaggucuauaagcacaguacugagggauuagagacagaaggauucucggggugugcuggugagccaggcuaucugaaugagugagcuccagguucaauaagagagcuuaucucagaaacugauguggggaguggcagauaaaaccagugaaagugagccuuuggcugcuucacacuuauguguaagcagguucuugugcacacacaggcauauacuacauauacuuagacauauuagcauacaagauacauauacauauauauauaucacacacacacacauauauaaaucaaacuagaaaagcuguuauuucugcuuucuugggggugggagccuuugaaaguccaucaacuucugcagaagaggcaauccuaggcuugguaggacacuucaggccuggcucuuugcugugacugcauuuggcugggucaugacccucuuguaugugucuuacaugccauacauuagguacuagaauuaaagaguaaagccacagcugaggggacaucccacgucgggggcaucccauuuauugccaccugguguccuuuacucuccuuguccuuucucaugacaccaccuucauuggugaacaccgacucccaagggucaugcauuugggauuaaggaggauguccugagcuggggcgagauggaccuggaugaagaaaagaaauucaaagauguuggcucugaacauggcaaaaguagccaugggacaaagaaggagaaacacuguccuugcuucaaaagacaucagacagauuacaguguuugaaucccucucucaagugaucuuagauaaggcuuauagcuuuguucuugcugcuuuugagccuagccuggucuuaaacucacuauguagcugagguugaccuugaaccucugauccuccugucugcugggauuauagguguaagugccuacaccuggugugugcagggcuggggauugaacccaaggccauucgugagugcuaggcaagcacucuaccaacugagcuauauagaugcagggcugccuuggagaaggcuugcucaucuuucaagcuauguucuggggcugugguggagcucggugguagaacccuugccuccugagcucauguagggccucccccagcucuacagugaaaaagagagcaagucuguuuccggcucugcucagccguguuugagaucuuucgugccucgccucaguuuccucuuggguauggugggaaaucauaacagcggcuacguuuuaggggguuuuaacauaugcacuaccacauacggagcaguuacagaauggccaucugucccccgaggugucauggggcaggggcugggggacacguuguguccuguccacuaccaaaugucaugcaugauaggugaaauuacuuguuaaccagauccuugguccuugaaaaaucccgauacuucuugaugaaucuacccauuuuacagaugcaauugagucucaaaaggcaggaggugcuuucugaaaucacccagugagcagggccuugguugugguuuucuaggacaacuuuguuguuuguuuguuugcuuguuuuuugagacaggguuucucuguauagcccuggcuguccuggaacucacuuuguagacuaggcuggccucgaacuccgaaaucugccugccucugccuccccagugcugggauuaaaggcgugcgccaccacgcccagcuuuuaggacagcucuugaggcagccagagucuacaauucaggaccacuggguuuuccagagaccacuguccaccucuuauuagagucucuuugucucauuucccuguugaguugguguugaaauaagagaccauccuaaguuggaagugcccuggugaguucaaggccaguucagucaugaccugugcuuuaggaucuuggcgucuuucuauaggcacagagcuguuuucagacccucaaaacaagccuuugcauugaugagccccaaggaaagaaguagauuucggcugaggggcagacaaaugacuucaaauccaagcuucaaggagggaccagcugagccaugacaugccugcuagagaguggauggaucgagccucccaggguggcucaggcucugcaggucuguggugggggauugcaggcuguuaaugugaaaucucaccuuuaauguguugacucaguuaaacacauaaacgggcccccaccauccggauuuacuggacacaucaguagccacaguggcucacaagcuauaggcucuuccaggcagcugaacacuuuuuuuuuuuuuuuuucgagacaggguuucucuguauagcccuggcuguccuggaacucacuuuguagaucagguuggccucgaacucagaaauccgccugccucugccuccugagugcuggggauuaaaggagugcgccaccaccgcccagaagcugagcacuuucaaggcucugagcagccaugugagcugccucuucuuccucuucuuguagcagccacaguguugaucuguguggucuuguuuggugguggcgucgucgucgucauccuaggaagacaucuaaaguuaaaaaacucacuuuccuuucacggacgcuuuucauaccagccucacagagugcagcugugauguuugaacaugauggcagcugcagagagccugcugagcuuucugcucaguuaagugagaaacuccuuccucacagucuguguucugcucuugccacgaacugcuaaaguucagaaagcuaacggggcggggcgcagaaagaacggagagaugacagagcucuggugcacaucacuagaguccugcuuguagggugacauugagugccauguaggcauccugacaccuaucccacuguuggggcucuuauguauuuguuuugcuugggcagauuugacuuugggcaagagauguccuuuggcaggcauagagggaacagaagauaauagcuugugcauucuagcaagugucaagguccugugaccagagaguggcucugcuaaaaccaaaccaaaccaguaaggguagaguagacagaagggacaguggcuggggagaugggaauauauguccacagaagggaaaagcuauguugaucuuccuugccaucccacgccuucaaaaauaguugacucaaccgauuuaaguauucaauauaaugauuaauuauaggcagagccauaauagggccaucaguacagucuagguuaggaccuggccagcuuccagaaggcuccauggcugucugucguucuugacuauccauucucuccuuagcugcuucccaucuucuccuccccccccccccgccccuuuuugagauaggguccccucacauacccuacagugacuuugaacuugcugcacagccaaggaucaucaccgugaacuucugauccuucugucucugccagugcugggcugacagguguggcccaccacaccaguuuuaugauggcaggggauggaacugugcuagugcuccacugauggaguguccacuccagcugcuccucgcucucugauuauuggagcacacagggguuuugccuuggcuuauaugcgcgugggggacauuuuuaccaguacugccgauguguccuuguugguggcuggaugaugucccgugguggguaggaccuggcagucuuuugggucuuccaucacugugacuuuugcuuauucagucucugccaacaguggaaccaagggucuccggcuuugcccuguuacuguaagauacccaccugcuucugcccacacucagcaucagggggagagauggucuuucuccaaacccuacagguaggacguaguuacuguuuagagcaggguugaaaaaaaauuucccaaaaagguuuauacacacauacuuaaacguaaggguuucuuuucuuuucuuuucuuuucuuuucuuuucuuuucgugcgguguuauuuauauuuaaaauuauuguuauuguuguuuugggugguuuuauuuauuuauauuuaaaaugauuauuuuuguuggugguguauaugugugcaugugcacgggggcaugugugcauguaggugugugugugugagagagagagagagagagagagagagagagagagagagagagagagcacgcgugcgcgagagagagauugguauguuuaguguuuaguucagguccuucccuuuacuugaguuccuggguacuacaguuacccuggcuguauuuucccucaccaggccugcugacuuuggcagggaucauggggugaaucucuacugcaaacaguguccuguaaacacgugugaaccgaggcauagcaaggaagccuuuaaucaugagaagggugucuaggucugggcuucagucuugagaaggggugccugggucugcuuacugcccuugccccguccucagcuucugccgcuuccauuccauuauaggggugacacguauuuuauuuucaucuuauuuuauuuuauuuuauuuuauuuuauuuuauuuuauuuuauuuuuugagacgggguuuccuuugcagcucuggcugucaaggaacucacucuauacaucugccugccucugcuuauagaauguugggauuaaaggcacgagucaccauugccuggcucuuuaauuaauaacuguuuaugaaaaaaauuaaauguaaauaccaacacauaguaacacuguaaacaguaccaugcaucuaccuagcuuguucauuuguugucacauauauauuuaagaucugccucccuguuuauuuuguuugcuuguuuguuucuuuguuuuuuaugugccaggaucaaacccaagguccuguacauaguugauacagcaguaaagaaauacucaacaaagaagaucucgguauggugugguagcucauauauguccuagcucuugagaggcugaggcaggaggaccacucugaguuuggguucagccugggcuacauagucagaacuugucuuauaaagcaagcaagcaaacaaacagaaauuagaacagagacaaacauauugaucucagcuacauugcagcccuccucuggcuuuuaugccucucuccauuuauguucuuuugcuccaggcuccagcugggugcuuacaauaucuaggugcucagaacucaggucugcuucucuccgaugcacuuggcaguggggccagauccugguuuguguugagcccuucgcuuuccaggaggugccgugggcaagcaugucauuuaccaagguuguaggccagcacaggguccuggaggugaggcuguguaugucuagucccaccaacacgugcccaaucaagguggaugugguggucugaaugagacuggcccccauaggcucauauauuugaauauuugguuucccauugguggaacuguuuaggaaggauuaggagguguggccuuauuggaggggccaugucacuggccagggcuaggggaggcuuuuggguuucaaaagaugucugcaauugacagucuucucccucugcuuugugggguuguggaucaagaugugagcucucagcuauuccucugucccacuagcauagacucuguuugaaacuggaacccaaacugaacaucuucuuuuauaaguugccuuggucacaggguuuagucaggggcuuggucugcuuucccaccgaguccuuacauggcaucuggcauauuccugaauguccugguugcaaacuaaaggauacagacgaaagauugaggguuagggaggaaauaucaaauaugcaauuggcaaguugucacuugcugagggucacagaaggcaccagaggauacuuggggguggggugggggggcgcuaacagaucauagugaaaaggccugaaagggggaagaauagauuguggguaagagaagcaaccaguguauguguguguggugggggcggggggguguggagcuggugugagcacguguccaggcuguguggauuuggugugagcacauguccaggcuguguggagcuggugugagcacauguccaggcuguguggagcuggugugaguacuuguuaaggcuguguggagcuggugugagcacauguccgggcuguguggaacugguggagcacauguccaggcuguguggagcuggugugagcagauguaugggcuguguggagcuggugugagcacauguccgggcuguguggaacuggugugagcacauguccaggcuguguggagcuggugugagcacauguccaggcuguguggagcuggugugagcacuuguuaaggcuguguggagcuggugugagcacauguccaggcuguguggagcuggugugagcauguguccaggcuguguggagcuggugugagccuguguccaggcuguguggaacuggugugagcacauguccaggcuguguggagcucgugugagcagauauaugggcucuguggagcugcugugagcccauguccagccuggggaggacaugcacagggagagggugucaugaggcuccagggaacagcugcagcgugucccagcagggaugucauugcuuccccuagaccacaccucacgcuucuccaucuuacugcugcucugccuggaauacuucucuuuauuuauuuuagauuuguguuguaaauguacguguauaugugugugccuacaugaauuucugugcaccguggauaugcaggcuccuugagaggccagaggaaggccugagaucaccuggagguggaguuuugggugacugugggcccccugauguaggagcugggaacugaacccaggcgccccccccccccccccgccacacacaccaguaacugcucuuaacugcugagucaucucaagccccucugugugugugugugugugugugugugugcugcaguguaccgcacauguguggugugcucgcucaugcauguguguguagaucucagagguugacaguaccugucucucucucucuccuacuuccuuuccuuguucucugagacaaucuccuggaaccuggaguuuccuguucuggcuggcccggcuggccauuaagccccaggaguucuccauuuucccuuccucccccggggcuggugucgcugaugucugauccuaucucaugcuuugacauggguucugagugcaggcccucaugcuugcauggccagugccuuacccacugagcugagaccugcggcuccuaggguaaccuuucuuagaugucagcuuccaugucacuuucugagggagaccucccugaucacucagagagcaucccucccguccugucauggcucacucugguuaagucuuaugguacuuauugcugccaaauguuguacuuacuaauuuaccggagaucugucucguccccugcuugaugccugucuuccagagcaaugcccggcaggcaccugggucugacacugucacugaccacgagaacuuuugauugacagcagcuugaguguaggcuuuugccagguacuuguuaagcucuugaauaugaacuuauuucuuuaaacccucagguccccuuguguauguuuuucuuuuuucaccuuaccagcaggaaguggaggucagaggggugacaggugguguuggugacacagcaggcuagggaccccaagcuggggcccuggacacggcugcggggaggggaggccaguuguagaucuggccacggagcaaauuaaauuucuguuuccguuaauggggagcucaggcugccccaucuaccugggcuggaggagguucaggacccaggcucugcuucuggccccgugcugccuuucugagagggaagcaauugcucaucuccccacuggcugcagcgggggaacugccaggagaugacccugcccacccuaaggcuugguuugcaaaacgcugagccugguggggaaaugaagggcuggccugcuaaccacagcagcaaggaggacucauuugcaagagugaggcuggcccggggcccugcucuguccccuagcagagccauuucugugggcaguuguccuguaggaacccacugggugcaaguccuuagcuugagcuuggagcggggugaggggaggggaggggagucaugcuagagccucagucuucuccucugaggaaugggcugguugugauaucaugacaggcaaagaggcuggugcuugagagcccuuuacuaaccaugagugcuuggccaggaauucccgcuauuacgcuguggagcuaggcgguggacaugaccagagacccucucccagucacuaucucacguagcugcuacacuucuggaaacaauucccaguuccauagcaguguaucgccuccauaucuuuuugaacaguuuacauuuaucuauuuguuaugucagagucagggucucauacagcccaagcuagcagagaccuugcugucuacuugaggaugguuucgaacuucagaucuccaccuccugagugccgggaugacaggcccgcagcaccaugccccgguucgacaguccuggggaucaaagccaggaccuugagcaugcugugcaaacacgcuaucaucugagguacauucccaggccuaaugccaccucaauuaaacuuccgggagucugauacagagcuggcccaaugccucacugucacacgaccacgcuuccugcaaagccaaggaugaggcagagaacgggauaagcgggccagaaggaguuugauggucccuugugugugcagucuggugcugggcccugauggucacccaugggucaucuugagugguuacaguaaaaagggagcaagaagcaggaaagaggaagucugggagaggaagaggagaugcacagagguggcugucggagcaaggcuuucguguggggcacucgaucccgcuugggcugucuuguggagcuggugccucuagagcuuucuccucccucauccugaaggaggugauaccaaaccaaggguugcauuuaggguucagggacucagacgggcucuaagggacugugggaaaaucaagucuuuaaagaacgagagguucugaggaguugggucaguacauaaggugccuacuguccaaguacagcgacuugaguguagguccccagugccuauggaaaaagcugccuguagagguuuguaaccccagugcugaaggggcagggccuauuggccagccagccaagccaaacugaagagcuucagguuuggugagugaccucugaugucaaccuugggccuucacaugugugcaaaugcaccugaacacacacaugcacacagccacacuaacugguucacucaagaccuacaugugugcacuugcacacaccccgcccacaugcacguacauacccacacuaaguaguacauacagcacauaugugcagguacccacacuaacuagugcaucacacacacacacacacacacacacacacacacacacacacacaguaagaucugugcuccccaaggcuuucaaucccagggagccacuacauaggccgaggcuuagguguaggguagagucaacuagggcucuggaauaaucucccagagaccaccgcccccacccccugcccacaccucaucugcacccucuucuuuuugugugguguugucagccuaacguuccugagcuagugugaccuggcugcaguuucucuaacccugucacucaccaccccaggguguuuggagaaggccuugugggaguuuccuggaaaacaggaggagugggaaaccagccuugcucaccuuaucuucuggccuuacacuuugagacacuaauuaucacccugauagcuuuggcaucaaaccucaaccagguggcccuggcugcaccuucugaggguggcucuucucaggaguuggugggaagaugaagcggcuggucaggcuggagcuaggccucuaccucaaggaagcccugucuguucucuguccaagucagauguuucuagcuggaacuugacauuggcagugcucugugucuacggggcugcugauggaauggccacccauccgugggugugagugucuuggcuuaggagcugagcccugcucuggaccagcagggcuugggcagagcuucccugaccuuuucaagccgguuuccuuuucugcaaaaaggaaacaaugaagaguuucacagcucagagaggcaggagggacucuguagaaaggccugggccugggccugagggaugggaacccugaauaacuacuucuggggucucggggcugugguuucuugcaagagugcucgggaggggaagucugaggaaggcaggaaauuuuuccuagaggggaacucuuggggaccaaggcccaccuguccuuucugagaaucuuuuuuuucccuaaagaauuacuaucuuaaaauuuuauuuauuuauuuauuuauuuauuuauuuauuuauuuuugguuucucgagaugggguuucucuguguagcccuggcuguccuggaacucacucuguagaccaggcaggccucaaacucagaaaucugccugccucugacucccaagugcugggauuaaaggugugcgccaccacugcucagcacuaaagaauuuuuuauuggcauauaucuaucaucgccaaaaauuaaugcguaacccauuaugacauguucauacaugaauuuacugcuuuaaaaaaaaaauucacucccauugucuucucuugugccccucccacucccccaguggucaccugcuccagccuacucucaaaucuuuuuauugugagcgugacuaguggguuuaauuaggguuaguuacagggcugacaagcauaaacaccuuaccaguggcuacaccacuaaagaaaaugucucuuagcugggcagugauggcucacgccuuuaauuccagcugccuggagucgggggcaggcugaucucucgguuuaaggccagccuggucuauaccuugaguuccagggcaccaggucagguuucuuaacaaagccugugaggggcggggggguggggguaaggaaagaaaagaauagaacagaaaaggaaaaaaaaaaagucucacccuuucucagcaacugcugccugcuuauaggucuuccgugagggguguggcaaugugagucccgcccccuccaugauggacuguugucggggcccaauccuuugcagguaaucacggaugucguacaauagccaucucaugcucgaagacagcaguucacagcacuccaaaccuuccucuggcucucaccuucuuucgucuccaccuccuugagccuuggacagagugauguaggcucucaugugaggcugagcuccuuuuucucagcaccugaccggcuaagggucucugcaguaaccgcuggccaucgcacagagaaacuucuuugaccuaaguaggcagugaugcuaaucuaugggcaugcacguaauuguuucuaagguaauuucacauguguauuuuggaggaggcuguccuuucacacgccccccugacagcccauggccucccugaugaugaccugaggcguguguugguugcauugguuaguagcugacucugauuuaaguucgauagcaaggaggaagucuuugcuuggggcuuggacgacucuugugcaucuuuguaucauucugcucuccagagcugagauauuugacccuguaggcacagagagaaaguugccuugcucccgcuggucugcaggaugcugcccuucucagcagaacaggguagaggaagcccggcuucacggagccaccaccuccuccucauucuggguguuggcuguaucuuggacugggugaccugggugaccuuggaucaacuucucaucugcucugaggcugaguuuucacaucugcaaaugagugucaugacuuugucauaggguugcugagagccagagcggccccagguaacggaguaacagcuaucaauaguaaagguauccagcgcguccucuggaacugucauucucuuaugcuggagggaaggcagcugaccuggaggugcuggcaggccugugguccccugaaggccuggggaagcucugcucuuaccuccugcucaccucggguugcacuugguguguuagauucccucacaucucugcuucugucaguagaugguccucuucccucugugugggccuuugcccaaauuucccucuuuuucuuuccuuuaauacuggggauugaauccagggcuuggcauauauugggaaagcauccugcucccgaacuacacuucagugcuugcuucuuagagaugcugucucuugccaugucuuacaauguauccuaggcugguuuggaacgccuauguagcccaggcuguccuggaaauguugcccuccugcucagcccucugagugcugagauuccagguacguguccagaugugaugacaucugucuucucucuucuuacaaagaugcucugggcucuggcucuucuucagucuacuccagcuuggccccaucuuaaauuggcucuauccucaaggacccuauuucuaaagaagauugcauuugguugguccuggcgauugggacuuacacguauuuuuggggggguggggagcagaaugcaaugcaaccgcuaguauuauccauucauacgucgucuccagcaugucgucuccaggugacaaaggccaaggcuggagccaucuuuacucugaaccccuguuauucagguuuucacacccuggggucugacuuucaguugcugagguggcucucacuguccacaugaugugggucugagauucagagagacaguacaacugcauugaaguuacagagugagggaggugggccuggauucuggguccccagauccuagagccaacucuauuccaaggaaccauguccccugugugcaugugugcacacagccuaugaauguucauugucccauguggugugugugugugugugugugugugugucugucugucugucugucugucugucugucugucuguauaccacaggccuguuucaacuucuggagccaagacacucuggaugugagcaguagugaccagcuucaggggagaggacuuuugggucuuggcuucuucuaacuuccucuuuuucuggcuagcaguuaacaaagaacccugacuuuggggcuggggauauggcucagggguagaguacuuaccuagccuaugugaaacccugaguucaauuccuagcauugaaaaaacaaacaaacaaacaaacaaacaaacaaacaaacccagugacauaauuuggaguuagaucacucagguucaaauccuggcuugacugguauggcuuagggcgagucaguaacucgcugccuuaguuuccccacgugugcugcaaugacgauacuguagccuuauagauggacacaagugacugaaacccuacugugugguccugugugugccagagcugacuuaaugagggcuccuuccccuuuaucccguuugguauuuuucugguaccaggagguccugggaaggaggauaagguguggugcuuuccaggggaggcaaagcuauagaaagcucucugcacagcgguaaaagagccaggagucaguggucuaggaaccuuuccuuuccauaaagaacacagugcacagaaaagccauguccuguaaacugcacacgcaugcauaugcuugcguaggaccacugguuggcugagguguguggaggggcugccuuugagauugggaccccaacuucccacuuccaugauagcucugcaugcccagccuuccuuggugcugaucacaacuggauucccagcugauuucagaagcgguggucuucaccaaagaacacccagugccaggccaacucugggccuccugcaggcacuuccucuggguuccaguacccugcuuaucaggaggccgcaagagcaccaucuauuucuggccugucuggaaauaguguggucuugaaaggguggagggcggagucagcuuuaggaacagagacaucgccaguggagggaggaggacucauuugacuucugugcgugcaugcgugcauguguaggccagaggucaaaaucaagugucuuucuguaucacucuccaacuuuuuuuuuugagacaggguuucccuguauagcccuggcuguccuggaacucauuuuguagaccaggcuggccuugaacucagaaauccgccugccucugccucccaagugcugggauuaaaggcgugugccaccacgcccggcuuccaacuuacuuucuuuuaaagauuuaucauuauauuaauuauuuucuuuuaaguauuuaucaugaugcauguauguggguauuuugucuauaugcauuuaaagggcaccguguguaugcaauaccuuuggaggccagaagucagcaucagauuccccuggaauagcccuaaagucacagauaguugugaagcaccccguggguccucugcaagagcaacgagcuuuuaaccucuuagccacaucuccagucccuguaccuuaguuuuugagacugggucuccuacuggaucuggugcuugcugaccuggcugggcuggcuggcaggaccuaccugucucuccugccgggugccaggguaaugauauauagcccugugccuggcuuuuacaugguuucugggaauggaaaucagguccuggcgacuguucaguuucgcugcacauguagaaguuuguaugcccagggagguacuggauagugugucgaaauaagguacuuuuuguccuuagccauacauacugcugucaccuucugaaaugcuagucuuuugaaaggcccuugcugauaugaggguagcauaaauggagaguuauccccugcaucccugugacugccuccccuaacccagaccuugcucugaccucuauuuccauuccuuacacagcgacuuuggcuucauccucugggcaguucguuucuuccuacgcuuuaaaacucaguagcaagcugacagacaguugcuucuggguagaauuuaacaaucuggucucauuuccaccgaagccaugacuauuugaucguucuucugcugcuugcugaauggcucuuguuuucucucugucagaguugcgaaaacauccucagaauugauuugcuacaguuaaaaaaaaaaaaaggcaacuugaggaaaauauuagcuacauaguaucaacagcgugcagccauugcuuaucacaaagcucuauugcaguuggagaaagaguguucaagccgaggugcugaagccaaacacaacaaagaaaacaaugcccagaccaagacaaagaaacuggccgguccuucaggggcuggaaucgagaaauagauuuuguguacugagggcuuaaugugaugguuaugauaaacgguagcaaagcacauuaaauauuaagugcucuuuauauaagguagcaaauccuuucugcauuguacuaacacuuauuuguaucagugggugugagugccagagaaaggggaucgggucgggggaggaagagagagagggauugagagagagagagagagaggagaaaagcucagguuauuaucccauuauuccuuaggucccaggucccuuguuuucuucuugagacaagggcucccacugguccaggacugaccaaaugaggcugucuggccagugagccccggggaucugccugucucugccuccccugugcugcguacaagcauaugccacuguagcagacauuguuacguggagucuagggauuguacucagguccaccugauugcacagcaaccacuucgccaauggugccaccucccagucccugacugugugauuucuagacauacacuauacguucagugugacaccuagugcucauuuuaaauggccacccucucuagaaucuuacauaggaaggaugacugauuucacaacuuagagguauaagauauguauuuguguguguguguguguauuaagauacauuacagggagacacagcaaaaggggauuauucuaacuuaguuuccagcaggaggagaaagggccaaauauaagggccacuguagcauugaacuugaaaggauuacaugcugggguuuuuuuuuguggccagagacuaaagcucaucuuccucccuaaacuugcaaacaauugagcugaaaaaaaaauggggggagggcaaggagggacagaguaucacguagcccaggcuggccucaaacuuaccauggauguagccaaggaugaccuggaacuucugauuuucccgccuagaccucccaaugccgagauuccagauggacaucauuaugcccaguuuauggugagcugguacugagcacagggccuggugcaugcuaggcaggcauccugacagccaaacuacauccucagcucagaagauaccuaccacaguguguccagauccugggcgcgugggcuuggugagcugccuggagagaggguuuggaacuauggccuuguacuuugguggcuugcucacccugucuccagcacucuugggugcucacagguggccuguagccaguuccucccucaguggcagggagccaagcagggcagguggcugcuucgggguuaauagaaccagaaaaggacuaggaggcugagcugaagcugaccugaccguuccagguucauuaucagaaaguaucccugccucucccuugacagggagugucuggggcagaaggugggaugguuggggcuuuggcgaccucaaacccacccagggacuaacaucucugcaggaacacaaaacauuucagcaaacagcuaccacugugugcucaugguugccagcauacucucuuuccguggaagcaggaggcaugaacgcucucuucuguuggcucuuaguacagucucuagaacugcggggucacuuucucaccaagacaguaagagcagucuuucccccccauccuuagugcuaaggugugugugugugcaugaguguguacacucaugcauucacacauauguacucuugcccguggcggucagagaacaaccuugagugcccauugagccucauggauucuucugucuccaccuccucagugcugggauuacaugcaucaccauacuaagauuuuuuuuuuaaaugugcacucugugggauugaacuugggcccucaugccugcaugacaaacauuuuacccacugaucuauaugcccagcucccaagcaaauuuuaauaucuuaggcuuuguucagaaggccagaccuggcucugcauuuuauauccauggaacaauggcagcuaaaccagaagagagugacccacccugggucccccagccaggaaagaguggggcuucaagccuaggucuucuggaugcuuccaagucucuaggcuacucaggcugcugugggcuagguuggucucuggucacaugcaguugcaugucaaacagccuggcaucuuuaguuucuuucaccacggucucuggcugagcucuuggcccuuguucuugucauauaaacuacaagcagcagaagggacuguuaagagguggccggaauaucauccccgguagcugacguaacuuugacagagacuucuuggggcugcaguuuguuuccuucgguucacagagcaguggaauagggucucuauccaugagaacugcgguggggugacgacuaggccauaacgguagaaagcagagcugggguuugaaccugggucuuuggacuccaggaugugcucaugggcuuugcucucucuucccuaccugagcccaucuucaagaccugggccagacaaacacauguccacucagaacaggcuucuccccuguagguaccggauccuacuggccucucauuuuccuguacauauguguacauaucuguacauauguguagauuuauauguguuggugacacugggcaugcucuauauuucuaggcuccuagaacuccugggacagagccuuguuugucacgucaucuugaaauccccggugcuggcuccuuuuggugcugagacuacauggguguaugaaugaugacuuggcaaggaggugggagcacgugugugcacgugugugcagcugucuagccuuccgucugucuuuccccuugacuaugucuugaggcuauaugaagaugcaguuugcuggcaaacagugccaccuaaggucagguacagggagagagagccaugcucuaggugugaaggauaggaggacaucaccaggggacacugcuggagguugaagaucaggagagggagaagcaaggagacaggaagauuuuucuggaagguuuuucuuucuuuuguucuguuuuuuugaggaagggucucaggcagcccaggcuggcuuugaacuccugauccucuuguuucagccuccugggauuaacagaugugagccaccaagccugguaaaaagcugaauaugaagacucaugucccaucccaggcagggcaaccaaggguagacgauauaaggcaagggaccgagacggaguguugauggggaugcaccacaaggguggggaggacaggaaguggaaggguggcuaacuccaggaaccagggugcagaggguaucuagaucuggggaagacccaagaugaugccaggaaggggugggacaugcaaaggccaggccuuguuuguggcuguuaucuugcuucuacaagcaggaagcccagccacgagccccaccacauaagacaaggucugagcucagcuacucuuagcuugcucugcaaagacaggugauuguuuuacugugugccugaagcagaaauccccaccagcacagacaaugaccccugaccauucugccccauauccuucccauuagugguauuuguugucaggaaacugggguggguggguggguggguggagagucuguugucuucuugugcuguuucagauacauguacaaauauggcucuuucucuuuggcugaacugaauauauuuguguguguguguauguguguguauauguauguaugugugguguguguaugugugugugcauguguaugugugauguguguauguaugugugauuugugugugcauguguguguguguguggguguaugugugcuguguguguguauauguguguguauguguguguaugugugauaugugauguguguguaugugugugugcauauguaugugugauguguaugugugauguguguaugugugauguguguguauauguguguauauguguguguaugugcauguguguguauguguauguaugugugguguguguaugugugugugcauguguaugugugcuguguguaaguauguguguauauguguguguauguguguguguaugugugauaugugauguguguguaugugugugugcauauguauguguguaguguaugugugauguguguguauauguaugugugcauguguauguguguguauauguguaugugugauguguguguauaugugugugugugcauguguauguguguguauauguguguguguaugggugauguguguguaugugucucguuuggcccaugaacuccaaggacuugucuuuaucccccagggccagccuuacagccacacccagcuuuuauguaggugcugggcaucuaagcucugcuccucaugcuugcauagcaagcacauuacccauugagccaucucccuggcccuggaaucuaaaacauuucugagaacacgaaggaaggcccguuuguggggcuagcaauauauucugucauauucaugacacaaaggcuauaggauugucacuuaaucugggcaucccaaccaguuuccuaagcacugcguagcacucagagcagacucuuuuagucuccuuccccauccuacccugccccccaguuacagagcauuuacucaaagaauaccacuuuuuuuuuuuuuuaugcuguagugauguaauggcugaggauguguuaugauuugaaugggaagagcccuucuccacagacucauguauugaaggccugguuccuagcuggugguauucuuuuggaagguucuagaaacuuuaggagguaggaacuagcuagaauguuccuggaguauacccuuuggaguuauaucuugccugggccucuuguucaucugucuguccacccauccguccauccguccguccauccguccguccauccguccguccauccguccgucuguccguccaucugucugucugucugugucccuuuccccuaaauccuucuccuggcugaacucugcucugacaccccauauccaucacgagggaguaaaacuugcaacugggagccaaaauaaacuauucuucccuaggguguuuaugugagguguuguacagcugcaccuauccaguguggugugugcgacaugguguagaggugguggggagauggcucauucgagaagugcuugcuggguaagcagguggaccggaguguggauccccaguguucacauagaaucugaacacagaauaaguagcuguaaccacagagccggaggggcagaggcagacugaugcguggggcucacuggcugccggucuagcugaauuggugagcuuucgggagagauuguugagugguuaagaguacuggcuucuuuuaaagaggaucuggguuggguuccuggcaugcacauggucacucccaacuuccugaacuccaguuucagggcauccucuucuggccuucacgggcacugcaugcaugugguacacaggcauacagguaaaauaaaaguaaguuuaaaaaguaaaguggagggcuagagagauggacugagaggguaaagguuuuugcucccaguucugacaaccugaauuuuaucucugggacucacagggggagaguugacaugcacaaguuguucuuagguuugacauguaugcugagacacucgugugaacauacacacacacacacacacacacacacacacacacacacacacacaaaacaaacagacagacagacagacaaacaaauguuuaaaaagcaagauggaaagcaauagaggaagagacccaguguugaccucuggccuuugugcucacuaguuuguccaagggaacccuccauguacacacacaaucauguacauagucauauaacacacauacacacacucaugguagaauugguagaaugcugaguuaccauguucuucuguguguagucugcuuugcauugucauggaaacaguaaugaaguaaucuguugaagcaguaacugaagcucagcucuguuagugugguaccaggcuuuugagcugucagcauuaggugucagaagggaccccauugaggggggguuccagguuuuacacaugaugcucuucaccaugcagagcggugggcgugcucuucucuugcugcugaccaaugcaagccuuugcuguuugugugccguuugugucguguuggugccuguacuugaacaccuuacaggaggucugaggucuggauggcgcauuuugggcagacgguaguguugauauccggaaagcaagaaccuaacguguugguuuggaggucagaggacaagcuuguaggggucagcucucuccuaccauuguguagguucuggggguuggacccaggucauuggccuuuacccacugagccaucuugcuggcccuauacuguguuauuauuuauucauuauuauuauuuauuagguauuuucuucauuuacauuuccaaugcuauccaaaauauucauuauuuuuuaaugauuccugaguauuguucaauuguauuaagaauuuaagaauggcauauguugcagaggauggccuugucaugcaacaaugggaggagagguccuugguccuaugaaggcucuauagaagccccaguguaggggaacugagggcaaggaggugggagugauggguagguggguggaggaacacccucauagaagcaggaggagggaggauggaauaggggguuuuaggggaugggaaaggggauaacauuugaaauguaaauaaagaaaauauccaauaaaaaaaaagggagagaaagaaaagaaaagaaaaugacuccgcaagauuggauuguaagccuggugguggugccuccagguuccugcccuguuuaaguuccuguccugaccuccucccaugaugagcaauaauauggaaguguaagccaaauaaacccuuuucucccccacccaaaagaauuuaagaauggauaggaaacauacauauaaguuucuacacuuagucuaaacuccauuaggagcuguuagguacagauauacaccugcgaucucagcgugugggaggcugaggcaggagguuuaugagcucgaggccagucgguuacacaucaagauccuaucucaaucccgcuagccaccucccugaagaugauuagaugcugucuuaguugggaacacuacacacacacacacacacacacacacacacacacucacacacacacaaacacacacacaaguucugagugauguuaucacuuucauaucuggggaaacagaggcaagcagagugaaauugcuaccugaagcuaccccgcugauggggagguugcaagacaaacccaggcuggcuggcucagagucccucagccugaacaccagccauaucaugucuugugaguuggaugaacccaggacuguggagucugucuacccaacucuagguucuuuuccuagccuuaggucauaugguaccuauguugcucugugccugaggugguaggauuaucacccugugggaugagccugcuuauuacaggguuccugcugggcaugucacuagagaugccacaccaacaucucagcuuugcagaugaucaugucuuaacggcacacucucauagauggagagggccuuuucucuuccugggagcucuuggucacugaauggcgaugagcagagaggagaacaccucagcuacccauggacuucaccugcugcucauccauagacuccggaagugucagucacggaugugaagggcuuggugaugcagccuccaggccugggaagugugaccuucaaccuguggggccugggcuugaagucuucugcuaucccagcauccccaagggucugauggauggagaacuaguuccuagcccucaaucuccccaagagaauccaacauagcacuugcccgagaugcuucacagcagccuugucaccagaaccaaguguucaucugugggugaugaacgggaagggaaaacgaggaauucaaguacucggggaggcggggguggcaucacccauagucaugacuggagugcugacucacgcuccagcaacagggagacuuugagaugguccuacucagcacagguguaccuugaaaaggucaugccaugggaaagaagccagaccagagaccauguuccuugauuccauguauaugaaauauccagaauuguugagugcagagaagucacgugcaguuuaguuguugcuccuggcaaugcggggcugaaaaaggauggggugggguggcgugacagugaagguccagguuuuucgcugugucacagaauauucuaagauuggcugugcccauggccgugcauauuugugaggcuuuacaacucaaugcacaggucacucgaaguggacggccuucucugguaugugugcuaugaauauuaucuuuuuccucguuuuguuuuguuuuguuuuguuuuguuuuucauggcaggauuuuucuguguuucccugacuauccuagaacucacucuguagaccaggcugaccuugaaugcauagacauccuccugccucugccucccaagugcugggauuaaagguguaagccacuaccgccuggcuuguccuauucauuuucuuucuccuucuccucuucucccucuuccuucuucucugccucuaucaccaccuucucuuauaaaagcaagccaccagcgcuccaguggacaccagcuaggugcccucugauucuguucaguuuugauaguucuuggcagauggugugucugaucucauagauuggggugccauccaucccauuggggcccccucacuuuacugguuuagauccuuugcuucuuacugaucaacuacagacuuaugaugacaacuaucuccuaggguuugaggacuuugcuaaaauggcucauggaccucagagaacccgucaucuucccugguuuacuguaaaaccuauuacagagaaggcagguagaugucuagauagcagagaugcaugcccagggcaggacauguguggagaguccugucucagccccaucccauguagcuuggcuugcuuacauccuccaguaaccuucguauguucaacagcugggaagugccccgaguuuuguauugcgcucauguaaaaacuucauuguggaaguugcacagugcauuaaaccauugcccaucggucauaccucuaccucagcccugaugaaagguuggggcugaaaguuuagauccugaaaucaccugcuauucugucaaccagcucccauccugagacucuaucaggagagcuccuggucacaggaaagacagaucaguuuggagauacuaugaguuuuagaaauugugucccaagauuugguggggagggugucagagaucaaauauguaccucuuauaucaauuuaucaauaucuauuuaucuagaaucuacuaagucugcuuaguguugauuacauguaaccacuugagacccgaugacccauagggggcucuucucuggagaaaacuguuugucucucagcagucauugauugccuguaacucaucuagggguuggggucuugugacauuucccgccuccauguugguuaucucagcuaguggcgucauuauacaggucuugcuuaggugaagauauuacgcauauuuggcugagaagaugcuguguugcaacgggcauccuggucgucugguucuugcagcuuuugcaccugaaugcagccauucagugccccccccccuuuucuugcuucaguugaagcgaguggcauuuggggcuguuggaacucaagggaaaagaagaugacaagcagaauuagucacuggcaugggugguacucuuagcaacacccagagaggucuccagugagcaucagucccucuccugcuaugauagaguaaucugggucuuaucccuaaagaccaguuccauuggcaaagcacaaagcuuuaguuuucugugucugucuugggaaggggaugcugugaaguagggaaucaccaaagccuuugugucaaccagcuuuucauugugacaacacagcagagacaacccacuaagauauguuugguuuugauccuugguuuugaagguuucagcccauggccacuuggcucaguugucccugggcuguggugacacacggaggaggggaacguguggugaagcacaggugcccaucucaugguggccaggaaggggaguguagguggaacgagggaaggaggaugaaggaaugauuuccuuccggccagacccuaccucuugucuagcacuccuaaugacccaucagguucuaaaccugucacuugaccaguucaucgacaaggccuggacucugauccagucaccuccucauggccccacuucugauggcuguuuucagugucggguucaagcuucugacagacaccugaguguuggggcacauuuaacgaucacaccauagcacccuuccuccugggccgccugggaggaggcagauggccugguggcuuuugguuuccuguccacacucaggagaauuggacccugagcucagaugggacucuggucagagauggacucacagcugucuucuaggaccgaggugcuggggucccagggcugcagggcggggcucuauccucuccugcagggaacuggggaaucugacaagcuuuauuuguuuucucucaguggacaucauggagauaaaggaaauccguccggggaagaacuccaaggacuuugagcgagccaaggcuguccgccacaaggcagaauguugcuucaccauccucuacggcacccaguuuguccucagcacgcucaguuuggcaagugggugcacauuugucuggacaucccuccgcccaccccccugccaccuccuccuccuucugagagagaucauacuucaugucugcuaaugcaugcucugggaacccuggucuuggguccccauccuacugcuuuguagcuugugucuuugggcauggguauuuaaccuuuccaaguugcaguuugcuuggcugugaccuggggacagcgauguggcuuucuccuugggacguugugagaaguauguuaccugucugccuggcucaaguugagaguuaaaugaagguaguuaacauggucacugagagauaggcucugcuggacaaacaugucacuuguuuccuacagugguugcugcacaauaaacacucaucugaaugaccuuggguacauaugcaggcacagagcacacacauauaugcaugggcauacaugaacauagcacauauggaugcaugcacacacaugcauguauauaguaugcaagcaugcaugcgugcacacagcauacacauacacacagcaauacauauaugcaugugcacacacagcauacauucauauguauccauacagcacaaacauguaugcccacaguauauacaugcauggcugcauacagcaauacaugugugcacauaugggcauaacacaugcaugcaugaacaugacacacacgcaacacacauucuugaacacaguaaacauguaacauauacgcauagcacauacaaugcacacacagcacaaaaugcaugcacauaccacacaugcaaaagcacacagaugaauccacauaucaauaaacacauguacaugcauauaacuaucacauaugccucugcacagcacacauauggaugcaugcacauagcacacauggauguacauauaaaacacuuaugcagaacucacauaugcacacagcacauacauguacacacuacacacaugccuauacacaugacacagcauacacaucucacauauguacauguauaaauacacaugugagaacguauaaacuuacauauccggagaugggauuucuggccaucucaaugguauauccaucuagagcucagagguagagcuaccauucacaaggucccagauuccagcccccagcagaaacaacaagagucacccagaguucacugcccccucuccaauucugucuacagcggacucaaaggaggaugcggugaaguggcucucugguuugaagauccuacaccaggaagcgaugagugcauccacccccacaaugauugagagguacacaacccacuggcaucauccuccuuuguucuagggucuucgggaauagaccaaagggagaaaaugggacaucgaguccccaaguucaucagugcccugugugcagcagccccugauaguggcuaagaacucuccagugcuccacauaagauccuuucucccuaguguugagccuugaccuuuggcgugaagagggcacuucagcugagauggaaacacucauugguguaugugugcaugcacacauguaaaugaaucuuucugugaauaucugcaagcauauaaauauuuguucauauacauucuucuauaugcccuucacguggauuguuuucagugugauaugugugcauaggacccagggcugggccacuaccccucccgcaaugaaccaacaccuucccacauauaccacucuuucuucucagcugguugggaauuagugauggggaguuguccuuuauggaggccucacuugaucucauggaugcucccucggggcucagacaggggucuucagccacagguggagucuuguuaccaagcagccuugugaggauguuggggaccccuucuccuuuuggggacuuuguccucauucccuagagcucuuugaacuugcaguauuuuugacucuccccucuuuuuggcuucacauucucuuugcaguuggcugagaaaacagauuuauucaguagaucaaacccgaagaaacagguaaggcccaucagcgguuuucugugaacugugauacuugcuuguuucaguguuuggggggcaggaugggucaguacaugcccugugguugaaagggucucagguucugggguugacgguaacccagaaugauugaaugauugaagcuucugauggagugaagcuccugucgugcugcugaggugacauuugacaugggucugggaccuugucacaaaggcuggaacaccuaccacguccugggaacccagcaggaaacauugugacgccgugccugcaauguaugaugggagagacugguccugagggagcaagcuuuguuuggugacaguggugugacucugggcagggaugaggguaagaugcgaugaugugccucucuguguauuucacagucccuggaggaugggacuuggccagccagcacacagggucucugucagauucuguguuuaauucccucccucucuccucccuccuucccuccucccucccucuucccccucccucuaccccucccucuuuccucuuccucucuuccucucucucccuucaccccaucuuucuguucuuagaauugaaccuuaggucuucugcaagcuaggcauucacucuaucccuuagccaugaccgcagcccuccacugguggauccuagacaagaguucuacugucucuagcuucuucuuuuuguuuucagacagaaucucccuagaccauucaggcuggccucuaacucucucuguagcccucaacuggcuuugaacuuuaaucuuccugccucaggcccuugcauagcugagcugagagaccuguaccuccaggccuguuuuguuuuuuuuuuguuuuguuuuguuuuuuaaaaauagauacucugcuuggguuuuuccuuaggcaaaggcagugcucacccagcaacuguuuccccauugguaaauacauaauggcuucugacuucauguuaauuuugugagagccaaccuuggagugugaacuugggugcuguacgugugagucggggacuuccuuaguugcccgaugccagcucccgguguaugguggcagaauauggugacaggggugacuuccagcuguggcgcugagggcacugaccugcccacugucucugcugcacuggucuuuguccuuugcuggccuggaggaugaauggccauagcauccuuuguuuaaauuugccuuucuuucugaguuggugacugguuagccucuuauuuccuuccucuaauuaauaaccaagcaauauaggccacccugggacuggagagaaggcgccgcaggcgagagcaaucuuugcucuugcaggggauucgaguuugauucucagcacccauauggugggcucaugaccaucuguaacuccaguucuaagggacccaaugcccucuucugaaauccacagguaccuggcauacacguagugcacauacauauauguaggcaaaacacucaugcacauaaaauuaaauaauauguuuaaaaaaaagaucccuacagacaaacaaacaagcaaacacuacccugcauggagaacuuggcaguggaugguguuaacucuuuauaauccuugucucgaguuugucucacauuggaccuuuuguuuaaaaagguuuauuuugagaccggacuauagcuuaucuggucgagugcuugccuagccugcaugcaggcuugacuuccauccuggcaaggguggagaugcagaccacuuuugcccuagcccuugggcgguugaagcaggagggucagaaguucaaggucauugucugcuguagaaagaguugggagccagcuagggucaugugaagccuuaucucaauuaacuaacuaacuacuuagcuagcuaaguaacuagcuaacuaacuacuuugucuuuccuugauuuugguuuucauauucgagacaaaacuaaccaacaccaacuuccccauuuugucccugcaucauagaggugacucuguccgucugucucuugcucauuucugucucuuguuuaguguauccagcuggggcauuugugaccccuagccacaugcauucucccuucugccucucccucucaucugucaucuccuggcugcccucugguguaccaccaggguugagcuaguggggugucguggguuuuacacacugaggucuuaggguguugucaucucugagacugugcucacugaaaagacuggcucagggugacagaaggggucacucuggucacacugucuccauggugguggaguugucuguccacuucugugucuuuguuuuguuuuuugagacaagguuucucuguauagcccuggcuguccuggaacucacuguguagaccaggcuggccucaaacucagaaaucugccugccucugccucccaagugcugggauuaaaggcgugcaccaccacgcccggcaccacuaucgugucuuauauggagcagagauggaugccugcuucuuccuggggauggauucuucaaauccugccuagaaacccaucuucccaucugccaagagggaaccuguuucuggaggugcucccucccuguuucuggaggugcucccucccuguuucugggggugcccccucccuguuucuggaggugcucccucccuguuucuggaggugcucccucccuguuucuggaggugcucccucccuguuucuggaggugcucccucccuguuucuggaggugcccccucccuguuucugggggugcccccucccuguuucuggagaugcucccucccuguuucuggaggugcucccucccuguuucuggaggugcucccucccuguuucuggaggugcucccucccuguuucuggaggugcucccuggcugucccuccacccagcuccucuuccagcucccucccagcaggcaggcccugcugcuugucagcacugagaaauagaaagucucaccuucucuaggaggcugcagggauacuucagaaggaacuuugaucccagagugcuccagaaagagcagccuggccaguuucccucccuuuccugucucccacagccucugacuaagcccguuucucagaggaaaacagaagcugccagaggcaagaauggacuggccuagcucaggcggagcccgaaccccagauguuuuccuuggcccaaguucuguccagcuucuaacuucuccuagggcaaaaugguagcagcuggcuuuugugauggacuugcuuggcaacagccacuggauuaggcacaucccaugccaaccaaaugcucccagccaaccacugggcgaggcacccauuuuacauguaaagacacugaggcccagagaaaucaggucuugugccuaaagccagccagcauguugaggauaacacaccacucuuuguaggcuugcucugcuuaucaugcagacauuguuucuuacccuagccaaauaacguugcaagaaaaaagaaaaauaaaaaagaauuuaaaaugacaguaaggcuucuacagcgucacgcuuaccuuguaagaauuuuaagugcacaguucugugggguuaauugcguucauagcauugugcagcuguugcuguguuccaucucgugagugggcggcaaguuccagcucacggacagggucaucauuaaaccaugacaccacaggccccccucuccccuccccccuugugaaauacagugcggcgguugguugggguuccugguggguccaugccaagcuacuccaugugacaaaccugguauaagggagguuuauuuggggaagggaggggagugaguguuagcauuuuguuuaagcuccccacaguuaccuggcaacggccagguaugccugacucacuguaaaaggggcuguucgcucccucuguccucucuucuugcuuucuugcucccacuccguccucucgccccuuccacccucucucgccacgugcucauggccggccucuacauuuuucucucugucuuucucugucucuaccuggagaaaagggguggaggcaggcagacuggagcagagccacgaaggcagaaggggggugggaguggggggaggaagcccggcugggaacacguggggagagaggggggagggcuccgaugaugacauaagcuguagcuaggucccugggaggagucuagcagaaucaccuguaagcuaauaccucccuccuggaguucugggagccguguccuguucgauuuggcugccuucagugccguaacacucuugccgauuucacuuggaguaaggcucucaaggggcuuauccccaccgcgggcaagcgcuaucccguggagcuacauccuucuuaaagccuucuuuuuacuuuuucucuugagagacagggucucacaugguugucuaggcagcaugccuuggacuugugauucccccugccuccgacggcggaguagcagaaccacuuuauuuuuugaggccgaauaauauuccaaaguuugcucucucucgugcuucugccauugugacucagugugcacgcaugcguagaaacaccggcagggagcccugcccuuccuguuggaucagugggaacugguuacgguucugaggaacaccugcgcuauuuuccauacuggucauguccucacauaggccccucagcagcgcacagauaguuuauuucuuccucauccuuaucaacacgauuucccuccauccuugccccuuggguuauaccacugaauuugcauaagcagaacagacuuucuuguucagaucugcagggaccgagggaaggcuguugggucugcaagggauauggaaggggaggcgcugcaggugggagagcuccuggaugcaaauagguuucaugugguugauaacccaagccacacuugugcggauuccguugcauuggccaucauuguagguaugggauuuuuuuuuuaaaagguuuauuuuauaaguauguguuugcauguaugugugcacacuguguguauauaugaugcucaagggaggccagguaggcuucccuggaacggaguuacagacggcugugagcugccaggugggugugcagaauggacccccccccccaaggucuuuugaaaagaggagccaguguaacuucuccagucccagcaaugucguuugagacaauguuucacuauguagcccaggguugagaaauaguucucaagggaaaugaauucucacuuccugagggcauggugaagcagcccucuuccuccuccucugccaguuuaaauguggggguccagaccccgaagaaugugcaguuuggcuaauccuugggaaguaguggucccuaaacagcugcaaauagcagggcccuugaucuacacagugaauguagggguugcugagugcaugggccaguggcagauacagugcguggcccaguucacccaucagaguagcugugugggguuggcugcuggugugccaaccagcaccaauagagaacauaggcacugcucuagaaaguuuugugagguuagccgcguuuggaggcacacaccugucaucuuugcccucagaugcugaggacuacauggugagagccugucccaacacacacacacacacacacacacacacacacacaugcacgcgcgcacaggaauagggagagagagggaggggaagacagacagacaggcaggcagacagacagacaguaagagaagcugcaacacugcuugugugauauuugggauaauugauuauuucugucuacaaagagcccugauguugcucucuaucuugcauccuggcuggaugccggcuugugggauucagugaguucacacuguaaagugccuagauaggaccuggcuuacagaaaagauucuacauuaaauauuuauuguugcuuuuauuauaaauagcuaugggugagagugggcuuuuuuuuuuuuuuuuuccuaagcaggcagguuucaggggcuccucuggugauggguguagccuugaaggcacccaggacccagccaggcuuuauagugauugguugaugaugucuguauaaaagacaggugucagcugccccuugggagaaguugguuuuugguugucauucacaaaagagaucagccugguuucugguugagcucuaggaugggauaugaguuucugauuuguguccaggaagcugaugcuggggacuaugaagaagcacaggaugugcaggcaacaggacuggcucuugcuuccggggugggaucaggcguggggguggggguggaggugggugugggugugggugugggguucugacgcucgcugcccaucagcucucuggaaugaagauccagggagucaaaucugcuuucuagcuuggaccugucaccugguccuggggcccccugccacaggaugggcuugugaguaagguacucgccaucuuaugaggcagguguggcuaagagcuacugacuuccuucccuccaguugcuggggaguacuccuguuagguauguguuucuagagaugggagugaggagagaguucugggaggggauucaguuguuccuaucaugaagaaccugaaauagcccuuuggucccugcuucugcagugucuuugguugggugucugguuggagugcauggguuuagcaucucagaugcucuugacuccugugccugcuccauuacucaauugcuaaauagcugcauuggcucuuggguccccucuuucuuacucucaguuuccagaugggggcauuuccuuuacuggugcagccugggcuccuagggccucugauuuugucuuuucuuuucuuuuauaaaauuuauuuauauuauuacagcuaaguucacuguaauugucuucagacgcaccagaagagggcgucagaucucauuacggauggccgugagccaccaugugguugcugggaauugaagagcagucagugcucuuaaccgcugagacaucucuccagccccgaccccuauguuuucaaucucucucucccgugucuugccauguggcacaagaggaaugucaccuucugaggcaccuucuauagucugcuggcaucucagcauagccagaccucuuggcccaguggugggagccugugggugccccuguaaacaccagagccagcagaauguugcucugagggaggcaaguagggagaaggucaguucagcacaauucacuaagagaguguugguuuaaguuuugagugucugacaccgggcaguuucuuucacacacguuuaaguacagcacaguuugggaaaaaaaagauucuugggugcugaucaacucaaucccuucuguacaguaaagcuuaaggcaugacugcauugacacuucuuuguuaaagucugugugaacccuuccauagagauggacuuuguagcuugggagacaaugcuuaacauaagggccucgguaggauggcugagauaaaccuaagugucuggggagccaggucugagcucacggggcuaucaccauucucagccuucugggcagagaacagguuauucaucucuucccuugaagggacuaccccgugauucuaacaucccuggauucccuagugcuuauguguaagcacaagggccucgcgcccuccacaggacccuugaacgcucuuugugcugccgugggagagcaagggggcaagaaggcuggaugugacugcuguaguguguggagucacacacgcggcucuucucugacgaugacaaaggccagguugauaaguguggagacccacacuugaggccggguucuuucugagcccuuuucuaacucugccggaugcuuggcucuuuggcuagaaggacccgagucucuuaccugugacccauccggcccccucauuucuggugucuuccgaaggucuuuggaaugugguuguucugggugagacugcagugagucuagucuaaccuugcucacacagcaggcuucucugagcuucgguuuccuccguggagguggcaguggcccuaagggcugccuugggaggcuuuugaauccugggagucuguagcuggaccuuggggagcagaccccuaaacgugauggguucuauuagcaucugcgucauuguucccuuuguccccuuuuugacccuuacucuccucuucucuagaagcucaggaguagcuccuggaaaauucugauaccaccuguucuggcuugaugacuguugugggauuugguuaggaucuaggcugcccuggguccagccgcagccuccacccauucugaacggugaggcuagagcuuggugcuguguguguauagauacaagggaguaggguggagaagugccauggcuuagcugacacuaagcuaccuggcacauagcagguaccacaugccuucccaucugccccccucugguucacucugcuuuaaaaccacgugagcauguuuccgagacucuucgggugccugaggcuugugguguucuacaaaccccauugggucucccacagcacuggcuuccagagccaucucccacgugacccaugucuacuaccaucgcugaggggguagggaccagccuccacuaucagguuguuccuuuccucuggcuuaaagggccuugcuucuaguugguuuucucauggaggggugccaaggugggggucgguagaguuguacaaugcuucccacucuggccacccugaggcuauugggauugagauuucugucuuugcagcaucagccuccgggagcugaagaccaucuugccccuggucaacuucaaagugagcggcaucaaguuucucaaggacaagcuggugguaaguauggcagcucagcugggggacaagaauuuaggcuugcuuagugccucucucaggaacccaugcuggccuggggcucuguggaauggcauccaacagagcccucugccuccgagcacauuaguccugguuuauccaauggaacccugugacuauuggaagacuucuugaggauggagcaagugaaggcuauguugcuggauggugugacuugggacaucugugcagaucugucugaaccagucugccuuucagcacuuucuggaccuucuugcaguuggucaccuuaguuacaggagcacauggguccuuuguaaacugcugcggcagaugccuuugagaggguacugaggacaucugccauugcguuuuguccucuuacucuaacugcccauuuuccuaauuguuguccuuucuucccccguuacugaaguaggcuauguucuugagcugugggugggacagccagcaaagucucucugccccaggaaugaugggaugcagggggcaaggauagauggauggaggagaugaaggugaaacuuucccacagagagaugcugucgggaaaugaacacgugguccggggagcccccauaggaggcucacccagucaugucagugucauucgugggauuccccuugcugaacaacuucauuccuuugaguacuacugaguuccugggacagcagacccaagcugauccugacccugccauucuuggaccugcccaucuccuccuccucaagacagaaagcaggcgugagagacagagagggagaagagaaaaauguuauuauuaaucccugugugguuuucucucuuucuuuauacauacacguauguauguauguauguauguauauauguacaacacuuacacacacacacacacacacacacacacacacacacacacacauacacggguccacucccuggccaaaauagacauguagucacaucaucaugcaaaauguguuuacuccaacuucaaaguccccauggccuuuuagucccaagacuguuguaaaguccaaagucucuuaggagacucuuggaauuguuguauauaugcauauguauauauauauauucuuauguauauguguuuacauaagaaugcacauauauauacauauaggcuagggaaucacugacuucagaggacguuggguugauuccuccagcuguucaguucuuguguagagggcggaggugugaggguggacacccgacuaugugcgcucaccuuugccuucugugcuugcaggaaaucggcgcacagaaagaugagcucagcuuugaacaguuccaucucuucuauaagaaacucauguuugaccagcaaaaaucgguaagaggacccucggcucuucucguguuugcuucaggcgcagagccgagaagcccacagggaaaggcuuagcuucccacugagucaaggacgcaugggcaagagugaccguggaugacuucaggagaccagcaaacggccgcaaccaugguggagcuguaggagacacgucagggcauggggguugcugaucuuccuggugggaauuccauagccauaaauuugaucauaacucugaguauaugaaaaacaaaauacaguauaaugcacagcacacuauuagaucaccuaggaaggaaauccugcaaauuauucauagccuucucugaguuuuaugauuuuaugacuuuauuuuugagacaggauuuucuguaguccaggcugaccucaacuucauguaaagcuggccuugaacuuccaauccucuuuccuccagccaaugagcgcugggauuauagagugaguuacccugagguagcagguuauagggucaggaggggaccagggcuuuguaugugcuaggccauacccccuaauccuuacagauauucaacuggggacuaaacaugcaaguguaugagccuauggggcccauuuuuauucaagccagcauuucccacucccuggccaaaauaggcguguggaacaucaucguacaaaaggcauucaguccaacuucaaaaguccccauggucuuuuagccccgagaccaccguaaaguucagggucucuucugagacucuuggaauugucauaaacuguuaaccccugugaaaucaaaauuaaaaagcagaucacaugcaauguacagugacacagaauauauguuaucauauauauaucauauauauauauauauauauauaugaccacacauacaugacacauacacuuugccacugucuucuggguuccuacuaggaugccuccuuaagccucacuuaaauuccuuucuuagucacuuucuguuguuguuaagacagcaugccucauccccaauccaagauguauuucaacuuacacucuuucacguugaagugaccucgauaguagccuaggcugucuuagaacuugcuauguagcccagguuggccccaaauugacucuccuacuucagcuuccccaaugcucagccacaaccuaaacuuuuuauuacagcuuaaaaaaacaaaaaguguguuucuguguaggcuugugugcaugugagagagaggagagagggagaggaaggggagggaggaugguagaaaggagagagggggugaggaggagggagggguggggagggcggagaaacauacugauugaauugagguuuaaggacucccuauucucccuggaaugugcuagguggaacccugggaaaacauucagccaugccaaggucgcccucugguggucagaaugccacauggcaccugaguugguaucucauuuuugguuuggccuguggguuggcauuuuaaaauuaaugaccuacauuuaaaacccagaggucuaggugaggcugcugcugcugcugcugcugcuucgucuucuucgucuucuucgucuucuucuucuucuucuucuucuucuucuucuucuucuucuucuucuucuucuucuucuccuucuccuccuucuucuugcugcugcuucuccuccuuuuuucuucuuccuucuuccucuucuuccucuuccuccuccuuuuuucuucuuuuuccuucuuccucuuccucuuccuucuuccuuuuccuccuccuccuccuccuccuccuccuccuccuccuccuccuccuccuccuccuccuccucuucuucuucuucuucuucuucuucuucuucuucuucuucuucuucuucuucauucucuuucuccuuuucuuccuuccccuucuccuuccccucuuaggucacagagcccaagagaccaccuggggucaggccagggauuguguguccaguaagucuagagguugcccacccagcuuguucauggccaagugucggaagggaagggcccacauucccugagauauccugauggcuugauggaucauuuuggaugcaggugauucuagccugagguagcugggaugggggauaggaauccucagauuuagcagugacacucugguugguuucuacccuggugacugucccugggcuccugaaaacucauugcucccaccuucagaagacgagacugucagcgugcugugcuauccuccggcccuuggaaacucaguuccccaucuucagcccugugggucuuaccgucuuccucucccuuugucggucccuuccccuguccagcuggggccuuccuugagcaugaggagaauaauuccuccauuauuuuagucagucaucugacuuguacaacagcuguuugcaugacccaaguggguaccgugcuuggcacagacauguccucugacccugcugacagcucacugggguggacaggcucacugauaucuggaguuacucagaccccaguguccacccaggcucccuguuggguuagguuugaccacagagccucaccaagaaaugcuuucuacauccucauuuggcuugugagccaagugccaaaugaggccaauaaucuccuugccaugccugacaccccaccuucucaaaagaaacgugugugugugugugugugugugugugugagugcuucugaauuugaacggguaguccaaccuucaggcuggugaugagagauguuuccagacaucuuuccagaguaugggacacccagguaccuggggcacccccuaucuccagccuguggguggccagaggacuugacuguuggacgcagagcuguuuacaagaucugucacaggccagugacuagagggucauuuccaccuagaauacaucucaccuuuacacaaucacuguguuauugaucaggcaggcaagguggacagaguguuugccaggcuguuagcuagaaacaguccaggagcauauguguauguacaugcgugcacacaaaaguguguagguacaccugugugcauaugcguaucucaaugugugcaugugagcauguauguuuguguuuacaugcacacacacaugagucuuguguaugagugcauaucuguaucuauacauauaugugcaugugugugcacagggcucagccagugagcuggugcagauggagaucagaagggaggcgcaucucagcuccucgaaugugcgguugacauuucagagggcacaagggaagagcugauauggcccuauguuccuuuucugcccugaaagcagaaugguaaaagggucaucugugaaauauuaaaggucugaaauacagcaguaaacacagaacaguguaaguuaccgcuuguugccgggaccacaguacccagauagaagaccuccaauggggaaaggcugaguuguggcccacggucucaguccacugugguggggacagccugguggcacucauggagucagagacaugugacagagacaccagagguggucucugguggugguggggguaguguguguaugugugaugaauguauguguggugugugcgugugugucaaugugcauguaugucaguguguauguauguaguguauaugugugugguguguaugcauguguguguaugcuguguauauauguguaaugugugcuguuuuugugaugugugcuugugguaugugugguguguauguauguguguauaugggguauguauacuauguguguguaguauguuguguguuaugugugcaguguguaugguguuugugauauauguguguuugugugugcauguuguauguguagugcuaggagucaaauccagguaaauaccugucuacccugaguuguaucuccagccuuuguaaaaacaacaauaaacaacaauuuaaaucucucucccuuucucucucucucuucucucucucuguuugaugggggcaugggaugagagggcuguguguaccauggcaugauuguagagaccagaggacaaccugugagaguccauucucuccuuccacugugaggacccuagguuguaagguuuggcagcacuugccauuaaccucugagcagucucucugguccagccucuauuuauuuaugaaucaaggucucccuguauagucuggguuagucuugaacucacgaucuucuucuucugccuuagccucucaagugcugggaugacaggugggugccaccacauucaaaauaccacauugauauguacauuuuauuuuucuuuuuucuaugccuguugagaugcugugauuucuguugcuagaucagucuaggcauuguccuacaucaguggguuuugcccaggcugagccaucuuggcugucucaguaauguuuccauugcaugagaggugcuguggucgaaagcaacuuggggaagaaagggcuuauuucaucuuacaguucucaggccgcacucugucacucugagggaagucggguaggaacccuagaaggacaggaaccuggaggcgggaacugaggcagaagccacggaggggugcagcuuacuggcuugcucagcauucccaggaccauccgcucaggggcgucaccacucccaguaggcugggccugcuuaaaucaauuauuagucaagcaaauguacuacaaacuugccuauaggcauuuuuuucaauugaggucugucuucccaaacgacacuagcuugugucaaguccgcaaaaaacuaacgaggacccuugcuuugauaauuuuuuaaaguaauuuuuccuuuauuauucuuuagauuuauuuguauuuuauguauaugaguaucuugccugcaggcacauaaugucaccauaugugugccucgugcccacagaggccagaagaggguguuggaucucuggaacuggaguuguagauagcugugagcugccgugugggcucugagaaucgaacccacaucuccugcaagagcagcaacugcuccugacugcugagccauuucuucagcccacugaugacuuagcaaacaacaacaacaaaaaaucucaccggcauaagcugauuuguccaaugcucuuaugaucugcuuguuucucguuucagauacuugacgaauucaaaaaagacuccuccguguucauccuagggugagacaccucgggcacguugcugcuguucagggccucuguguccuuguagcucugguggcggguggggguacugugugcaguuacugaccccagcuuuguaggacagcaggagcgagugaacagaauccguaagguguggaguauugugaggagggucuagaagauucuguagggaggaccgugaccucaggcuuucuucccguagguucaggggaugugacaaaccaauagguuucucuuucccccugcuuuccccuccuccccacccccaccccuucucuuccggaugcgccucuucccucucugguuccauucuguuuguggacuccacauucugcugugcuccccagaccuccuggagcuccugagugcuguccggggccucuaagacucuuugguugggaucccucuuugagucucuuaaaucucgacuucgagggucaguggugugcucagcauggcugggcugggguucaggguagaggugaacccucucucuaaccacccugugucauuucucugaggacagaaacacagaccggccggaugccucggcugucuaccugcaggacuuccaaagguuucuuuuacaugaacagcaggugagaggauugugagguggggugucagggacaaagugcuucccuggaugccugcugucauagaauagcuguggugucccugaggugggguagggccuuagacugcuguccaauaucaccagguuuccucaaauucccagucucucucucucuuucuuuguuucuuucuuuuauuaagauuuauuucuuuuauguauaugaguacacugucacugucuucagacauacuagaagagggcaucgaagccuauuacagaugguugugagccaccaugggguugcugggaauugaacucaggaccucugggagagcagucagugcuccuaacugcugagucaucucucuagccccuuccuuccuuccuuccuuccuuccuuccuuccuuccuuccuuccuuccuuccuuccuuccuucuucccucccucccucccucccucccucccucccuccuucccuuccuucuucuuuccuuccuuccuuccuuccuuccuuccuugaaaauagauucuucucucauacaauacauccugacuacaguuccucccccacuucucucagucccccccccccccgccaccuccccucuccuccagaucuacuucccaccccuuuccucuucagaaaagagcgggccuccaagagacagcagcuaaacaggaccaaaccgcauacaacaaggcagggcaaaaagcucucauauggaggcucgacaaagcaacccacaaggaggaagagucccaggagcaggcaaaagagucagagacacaccugcgcccauugcuaggaguuccacaagaacaccaaacgagcauuccuaacaucuacaugaggacugggugcagacccaugcagcucccaugucugccgcuccagucucugugagcccaugaaguuuuaguuagagcaggaagacagcugaaggagaucaagggcguucacauuggaaaaggauaacauggcgugcugaaucuugucgcgacuuccaaugagcaagcaauggcaggggacuugagggcuugaauaagaugucccucacccuggcuggugccagaucauccccaggggccacaccaggaguguuuuccuggguggccauuccuucuggaugggaggaggugacuaggcugaccaaaccugcugguccccugggggaugagaacuaagacuccccagauggcaucuaugugguggcuccuagugugguggaagagucacaggaguuuccuguugggaugucauuaucugaugguacaaagucacccuaguauguguguguguguauucuuggguaccaugcuggugucuggcgagaagaugccguuaaacguuccccugugauacacguuuuugagacauguuuuacuaaguugcucaaacugccauugaacucccucuuuagcccaggcuggccuugaauuccuucuauagcccaggcuggccuugaacuugcuguccuccuggcucagcuuccugaauagcugauacaaccauucuguaccuucacacucuauguuugggcucuaucauaguauagugauagaaagggacuagugaucagagagggacauuuaccacaagguuaacagccugagguugggcaguggcagcugcuggcucggggugcugggcaugcauaccacgccugacagcauggaacacugaaugcaggugauggaggagagagguucuguuugcuuagccugagugagcucuuaagacccaaggauguuaaacacagugggcagugaauucuguugggcagucugaggacggcuugcugggacugcuaaaagcuuuccuccuaccacuaguguccuagcgaucagauuuuagguuguugggcuugguggcagguaccuuuacccucaggccaccuuaccaucccacauuugaaccccuagcaucuugggauucuaaacuucuuuaggaagauccuggucucugcccagccagaaagcagccuccaguucuauuagcaagugcucaugucuuuugauaaacgcgugugcuuugcaggggaaggagagaagggccauucaggcccuuugagguacccagggagccaagguguuugcacuaagcauccugcacuugugguguugcuucuugguucuccccccaccuccacccccacagccgaggacggaaccccgggcuagugcucuaccacugagcuaaauccugaaccccaugcucuaugcuguuaacaaccuuccauucagggaacucacagccugcuggcuauuuuggugucuguggucuggggagacuuguuagcuagccacaguccuguguugcugaaguagggccucaccauccuguuucagucugucuuugggcuuuuguucuuucugacacacccccguccccguccccccacccccaccccaccccgugucccuuccuacccaaucacacauucaucucagacacaaggagagacacuggggaaugucugaaacccagaaggcauuggccagcaucgggucugugguaucguucaucuuguugccuguggauauuugagguuucggagaauguagcagaagaaaggucacugcaugcugugguuuuuuauuaaggaaauguuucuggaauguccagcauuguacugaaucugcuaguggggcuggauuugucuaucgggguggcucugccuggcugaccccugggggaggggaugcgagguguccaucucaguucuuuugcccagguugagugauuuggaaauugacccugguucucaugagcucuggagaccugggaucgucuugaagucauccugagccuguguguccucuucucuaugugacagugacaucauauggcuugcaggguggggcagguuagaggaccauacggggacgaggcuguuagaauaaacuaccagaaacuggaggcuuccugcagcgaagaacacugcacuaagcacacaacugacuucaugugguccuguuuccaaaccugcgcgguguauaacuuuugggacccuccuuucauggaugaggcuguauaaagaagacacgugacuugucaccuuggcugagccaggggagacaccccaguaggcuggcuauacuguauaguuacuuuucucguugcugugaccagaagaaacuauuucaacugggcaggcuuuauucuggcuuagacuuagaggggcuauagcccaucauauuugggaagagauggcagccugugggaacagcacagugacaggaaucggagcuggucacauggccucucucgucaggaacaggaaguggggcuggacuauaaaaccucaaagcccaccccuagcgaccuacuuccccuagcaagccucuuaucucuggaagguuccacagccuuuccagacaaugccaugaccugguaacccagguguucaaacacaugaacccguguguguguguguguguguuggggggggcggcauuucauaauuaaacuguuaacacuggcauaguccaccacagucccuggcuguuucauacugacacccguggccuagugcucugaguucuuagcagaucauagucugucguuacuuuuauugauaaaguuucauugcaauacagcuaugcucauuuuccuguauuuggucuguggcugcguucacacgguggugacugcugagugaggauagcgggugacccaugcagaaggcaucugcucgccccuggcaaagaccaugccaggauggagccuuauuuauguggcucugaaugacauagguuugacauuggguccagucuuugaucaccuugacuagguccugaggaggaccuugccuguccuuuggugacuuuguguuaucuucgacaucuuuaaggagcuaugggcucaggaucugaacaaaguccgggagcggaugaccaaguuuaucgacgacacaaugagagagaccgcagagcccuucuuauuuguggaugaggugagugggcuggggcaugucacgugagcaggacuuccuuuaucccuuccccucggaaggugucacugucagguguccgggggacugacuccguguaaggagugguuuucccaggguggggauuaauccugcuuuucauuuuccugauucuuaccugggugggauuaccuguuucgccacuagagggcguucgccaucagggagaagccaacugaacuugacaaauguuugaugguugugugagccauuuauagaggacacuucuuuuuacagguggccggggaggaucagaagggacauggcuugucacuugcucgcuggggcuguuuauggcaguaaaauguaccucugagccagucgguguuucugauuuauuauuauuauuauuuaaaugcuaggaguggguagaugggaaagucccugggccccuucucggccuccuuguuuuugccaugguaggaacugaacccaggaccuucugcaugcuaggcagggguucuaccacagaccuauaacagugggacucuuuguaauguuuauuuugucccuccacccggcccccaggaggucagaggacagacagccuuaaguguagguccuaguaugcauccuuauuugaagcagggucucuuuaugcugggcucccagaccuuggagcuucugggguuuuccccaucuccauuuuacaucacaguagaggaaccaugaagccaucucuccagcccucuucucuuuucuuauuauuuauuuauuuauuuauuuauuuauuuauuuuaaagcuuccaggaguugggacaggaaacucugucccuuucucucuguuucccuuuuaucuucaguuuuuuuuuuuuuuuuuaaaaccugaggcuuuguacccauuagccaaucacucuaccacugagcuaauccccagcccuccuuuucuuuuugcuuugaggcagguucucaguaauuuguccaggcuagaccugaacucccuguagcccagacaagccuugacucugauccuccugaguaucugggaugacauagcugagccccuaggccuggugucuuuccacccuuugauguucucauauccagagugcucugucuccaaagcugugcuggacucgcagaggcuuagucgcugauacaauguaacgcuucggugugggcagcuggagcucugacagcagcagacauuugggauacacguuaaaaagggaaaugguggguagguccaggaggugcuuauguugauacggggugucuaaguuaggguuuuacugcugugaguagacaccaccaccaaggcagcucuuguaaggacaacauuuaaaauuggggcuggcuuacagcuucagagauucaguccauuaucaccaaggcaggaacauggcaguguccaggcaggaaugaugcaggcagagcugagaguucuauaucuucaucugaagggugcugguggaagacugacuucagggcagcuagacugucuuaaggcuacaccaacagacacacacccacucuaacaaggccacacgcacuccaacagggccacucucacuccaacaaggccacacccacuccaacagggccacucccaauccaacaaggccacacccacuccaacagggcuaugccuccuaauagugccacuuccugugccagccauauauaaaccaucacaagaaggauggcugcaaucagagccauuuguacugaaaccucgagaaaccgaugucuggggaccaucuauaaguuucacaggucagagccgccuugccuggcugcucaggugccagcuaagaauaaguagacucugugccucuugugccacggugacuccguguuggucgucucuuucaguuccucacguaucuguucucccgggagaacagcaucugggacgagaaguacgaugcaguggacaugcaggacaugaacaaccccuugucccacuacuggaucuccucuucccacaacacgugaguuuccggaugagcccaggcuggcuccggcagagcuggcugugaauggguggggagggucaaagggguccgggaacacagcucucuuuccagccaguaucuauggccuuuuaaacuuuuuuuuuuuagauuuuuuauuuauuauuuauuuuauauguaaauacacugucgcugucuucagacacaccaggagagggagucagaugucauuaaggaugguuguaagccaccaugugguugcugggacuugaacucagaaccuucggaagagcagucaguguucuuaacugcugagccaucucuccagccuucuauggccuuuuaagcaacuuuacagagcagauguuuuaugacuuggucaucacaccaucaaaacguucacucagccagugagcugguauuuguggaaacaucugacaugggccaggcucuucgccuaugagguguguggacuccucagugaacgagggagucucauucccuggugcuuagagaagaaggcuuccagugacugucaacccuaggcaucagcugguggcugaacagaggcagggugagaaggagaguuuccugcaugugcuaaggcccuggggcaggaacagcugggaggcauuuuuaaggcuggagugagaaugaagagucugggaggguagcagcaggcuagagggccagcuuauaagucacagagagucacagggagccuccgaccucuucacccagagagugacagagcucaucuacuucuuuggguaauuaugcugauugcaaaugaguagggugaugaagggagugagcagggaugcugccuccuggccucaguguucagucagacuuucagggugaggguuuguuugacuucuaggcugcaaagugcucuuucaaacaggggaugagaaaauccccucugcccccgugugucauccucuagguauuugggaaggugaccccuuuuccaggggaauggguaggcggugcaucucgaguucuuaucuuaggaugguggauucuccaagccuagagacagcugaggaauuguccugagaaggcagguggucuggagagaaggcaaggcgauagucauuugucuuucaaaacaucaaaagcucucuuaaauaaccuaaucaaugaaugcucuaacagaggaauggauacagaaaguguaauuccuauguaaugcauauauauguuacacauauaucacgauagaacuuugcgaggcuguggaggaaaugagaagucaugacauuugcaagaaaauggauugagccauaaaucauuauguugagugaaauaagccagaucuagaaacaugacuacugcaugcuuuuuaaaaaaaacauauuuuaugguaguuuugcugacuagguucaugguaccguaaauucuaccaggauuugcugagccugcccacgcuggccgcagaucucagugaugaagcaugggccuauuucugcugauacccagagcccagugggcagcuccaggggucauuagcgcggguucugcuucgucuucacuccugacacccucagcucaggucuccaaaagguccauacugucuucauugcauucagauugcuuagguagcuaucgugcacaucuuauuggugguucuggacccaagaccucaggauggcgugcguguggcccagaccuuagccuggguguuucuccaucagaagaucuugggcucagacggucuccaagcaugaacuguguacaggauugccucucugacucgggucauucugucccucagguaccucacuggggaccagcugcguagugaguccuccacggaagcguauauccgcugucugcgcgcugguugccgcugcauugagcgugaguuuuccgucuuagccaagaugaugcaauaagcaaagcuacgauugcucagugcuugcuuguugcuuuuauuuuauuuuacguguguguguguguguguguguguguguguaugagacagagagggagagggagagggagagggaaagagagagagacuucaguuuuggugggagauggggagggagacaggcugagaaguccccaugcagagcaacucuaggcagggaacugaggugacuaaggauuuuuuccuaaaagauaacuguccccaagcaaaagugacaucugguugggcaauagauuggcuggugcaccuagaaagagucuuuauaaagugggaagcaggggaccagcagcaagguccacuuucugcuaagaggaacacagacacauacuaguuagcaugacacaccacacccaggagccacaugucuguaggugagggucugagagcaagcaugacagggacagucaggggcagucuguggcugagcagauggcaaagccuugcuuuugucugccuuuuuuccucaccucuuuggcucuuuguguguauguguguguguguguguguguguguguguguguguguguguguacaugcacacauaaguguguucacauguguguauauaaccauguguauaacccagagguugacagcaguuguuuuccucaaucacucuuuauuuuuaagaaagcguuucucagugaaccuguagcucuagccuagcuacagcuugucucauacaucccuugucuccacuugcccagugucuacaugggcucugagauuugaacucugguccucaugcuuacagaguaaauacuuuaucccuugaacuaucuccccagcucaucuuugguucuauccuucccagacucauucuaucaccaaagcucuuaugugucuggauuaguuagcauccuaucacuguaaaacaacugagguguugagcuuuuaauggcauauuguucuguaucuuggguugggagcauugcuuugggccuuugaugauaggucauggcaagaaaacguggcagaacaaacacuuugaccauaagguagaaacugggagaggacaaggaagaggcuggggucccacagucccuuucaaggacacagccucaaugacgcuacuccaggaaccacgcugggugacacuuuucuaagccauagccauguauguggcuaagaaaauggcccagaccaucgauggcaccuuaaguguuucaaaccugcucguucugugccagagauuaguagcaguugcccucaggcuuccuggguuuaugcuuuuuccuuuggaaaaagagcugugagaaaaugaagucagaagucaccagcuuugauauccaccaguuuguuaccaugcucccacagucuuauuccauuugcauaaugacugaaccuuuaaaaaaaucugucuguuucuaacuggcaaaagaggggagccuugaacagcggacacaagcaaaucaaacccauuuugaauauuuuauaaugaauggcucacuagaaggaguuucucaggaagugugucauguucugcaagucuguagauaggaccauggaugugugggugaaccugggucagccuugggaacagagcuguuauggguaccagagccuagccugauggccucagcccaacacgugucuuguauacugguucacucuugguggccgugguugaugguggcugaugcugagggccuguguuuuccccucaguggacugcugggacgggccugaugggaagcccauuaucuaccacggcuggacacggaccaccaagaucaaguuugaugauguuguucaggccauccgagaccacgccuuuguuaccuccaggucaguggcugauuuccuggaggugugggccuguaagggaaaagcugcuaggacuggacgcauggauggauggacaggcagacacagauacacacauacacacauugcccacuucucccaaagccugggggagcuuggacuccauuuggcuaguuacuaucaaguggccuuuguguccuuaagacaugauaauggcccuuaaauauuacguuuauuauuguaauuauguuuauguguuuguguguuugagugggugugugcccaugagugcaggugcuagcggaggccagaggcauuggcucuccagcugaguuacggguggcugcgagcugccugagcuuagugcugguaacuaaacugagguccucggagagagcaguaugauaagcucuuaaccgcuuagccgucucuugggacuagaacccaagaguucuagaugcuuuuguuccgguuuguccaguguaaccgcuacuuuauuggguucuucuuucuaccacccuucuccaccccaaacccuuucaaccccccaacaccagguaggagagaaaggaggugagagaggaaaagggauaucaauccuguuagacuauuuccugcugauuagcgguguugaguuccuugggggcaaguccagucuuugucugcaggauagccacuuucuuuuuccuaucucuuugcucacgaccauugacaaacugcagccacugcaaccagcuccagcuucagccucugcuucugucggggcucuggccuuuuuuaauguccuuucaagaguccccagaauuccaagcgugaaguaucaucagcuggcagaaucaugccccuggcauagcacgagacaaaucacagucagcugcuauggauaaccugaagcauccccuguaucccgcaccugggauugaagcaaaaacauagucuuaaguaacauuucuaugucuuuaaagacgccaaaguucucauaguccugcucugugaauggccagccuuugugguucuuugccaggauccucacaucuuagcagccauggugaucacuguauggaccuggaagggucguguguugaacgcuaggugccaggcacggucagcguucaguaaauaggaccggagguuucugaggugauuccugccugaguuccuuggaucaagugugggguggggcugagacagggaugcugcugcaagcaucuucucuccucagggagccuuuuagccagacuacagggcucauauacauccuuccccauguagccucagcccuuccuugggcauuccucucucuaucugccacugaagccccgagggacccuguguucccagagauggucaaugcccacucagacuuuguuagcuuccuaucaugaugaaaagaugcugcuauaucggauuuacagagagaagggggcucaacugggaucaugcuucagagaucccaauuacugaccuaccguccacccugccccagugccugagaaauggguguuuucugaccaguagaggcaaugaugaaagguuccuggaucuugucccccugcugacucuguccugugccaccugcagcuuccccgucaucuugucuaucgaggagcacugcaguguggagcagcaacgucacauggccaagguguucaaggaaguguuaggagacaugcuguugacgaagcccacagaggccagugcugaccagcugcccucgcccagucagcuucgugagaagaucauuaucaagguaggcguguggggcugcugucuaccugggacugccaucauugagggucuguaucagaggucuggugccagacuccaggucccaucuuccuuaccaucucucugaucuugguaagaucuugaucauuuaaccucugggugccucugugccccucugguaauggggaugauauagaaucuaguuacauagugaccuugguaggagcaguucugggugugugugugugugcagaaugguuggcucauacuaccaauucuaacuuaggaagacgaugaguuccagccagcuugggcuggagacucaguccuagugagacucugucuuaaaaaugaagcaaauggaagcugugugagcguugggguuccaguggcucaggccccauuccugcccuuggggucucucacacuaugugagauguggauagcugcuuaacaggguuugagugacagugggaugcuggggcugguguucuuguucuauggaggcgacacgugauaucggacuuuggggacaucaacauuuguauacuuguguuguuaggauaaaaagaccagaugaguagugaaauaaaguaugcacauguuuauauuucucauacaagguaggauguuuuaggagcauuaggcuuugguccccaaagugauuuggggacuaaggauccugacguccuacuguagcugcaugguggggauuuucagugggguuuccacagguccccaaaaagucagaguuagaauuuagcauggaggaagggaccugggagauuggauggggaauagcgcagcuuauuaaccuauaagcgacaguaacacuucuucucuuuugcucaguccccaccucccacaaaagcacaacuuccuggagaauaaggaaacagaagcagguuuccagcuggacagaaggcagggaugggauaaagauggagaggcaaggagggauaccuccgagggaggagaguucgccaagcacagagcugagauuauagggcaugacagacgaguuggcaaagguggagguggagagagcagugcaugccggguggcggaugguggcugaauucuuguugcuucaaagacucugaacuugggucuccagugaggagggcuaugugaacuuucuccccuucagcauaagaagcugggucccaagggugaugucgacgucaacguggaggacaagaaagaugagcacaagccccagggcgagcuguauaugugggacuccaucgaccaggugagucugggucccuccuccccucacagagccuugggugcugacucucagcuguccuaggcuuccacccuaaagucuggcacugucccugccuuugcccacuuggagccaugugacuugucuuuuuuuauggcauuagaauguuuucaaauaauuucauauuccauaucauaaguacuuauacacagaccaaugucauagacccuagauucauaacacucccaugaugcaccacagcugagggcuccuuacccccugcccugccuugaccuugcagaaaccucucccaaauaggaguaucuacuaugacugcaacuaccggagcacccacagggcugugacaccaucagcuccuuguggaucuucuuuccguaucgugcccuuuccucuuuguuagaugaacccuuuuggagggcucagucuguggcugcauggcucuguugcuucugcgucguuaguucacugugaggcagagcauccugacagggaacuguguaugugugaacaagccaagugccucacucaccucauggugaauggggaggcagagaagauaagagauaagagguuagcccuucagcugggcgugguggcgcacuccuuuagucccagcacuugggaggcagaggcaggcggauuucugaguucgaggacagccuggucuacaaagugaguuccaggacaaccagggcuacagagaaacccugucucgaaaaaccaaaaaaaaagagagguuagcccuucagaggcaaagccucaucuccuucagccaggccagcucccagcugucuguucacuuaugaacuuaucaauaaauggacuaaccccccucauggcgugggucauucccaaaacccuacugguugacaagcaacccuuuaauacauaguccauauaggaacaggcuuuggauuaagcuauagcauucacuaacauccuuuucccaucacauauauuagcagucaacuugcugcuauguauuagcaacauuuauuagcaggcaacuugcuguggccuuccaaccugggauuggguccacccuagguaauccucauuauuaucuccuucuccuucuucccaccaccaccaccaccaucaucaucaucuuuuucuuccuccuacucccccuccuucuccucuuccuuuucuuaauauuauuuauuauuugugguggaauaaagucuuucaagcuuuaaugcuucucccauaccuccugauacuccuauucauuugaguuauccaaaggccugucuguucuaguacccuauaaauaugaaauaaggagaauuuaaguaaaucucaacaaaaugucacgcauccacaguggaguccgauucagccucuaagaaugaaauuauaucauuuacauguggagccugggaugugaaaaagauaaacaagaauauuggugcuuuaucucauauguggacucucuauuuuuaagaaaauuuaaauaucugggggauggagagaugucugagaggcuaauugcguuugcugcucuuccaggguauuuugaguuuggugcccaggauccacaugggaggcucacaaccauaucuaguuccagccucaggggaucugaugaccucuuguggccuccauggacacugcacucaugugcacucacacacacacacacacacacacacacacacacacacaccccuuuucauucauacacacacacacacacacacacacacacacacaccccuuuucagucauacacacacacacacacacauacacacacacacacacacacacacgauuuguuacauauaaaugcaugcaguuauaagcauuuaaauuuguaugugugucauggauaugagugguauaaaaguuuauaucacuauuuguugggaaugggagaagcacagggagggaggaucaugaaagaggcaauagggggacggaucuagucacacaaugauauguauguaugaaaaauaucauaaucaacucuauuaaaaauuuuuuuuuuuuugagacagggucucacuauguaguacuggcuggcacugaacucacagaaauccaccugccucugccuuuggaguacugggauuaaaggugugcagcaccacaccuggcacaccuacaauauauauaauauauaauauauaauauauaauauauaauauauaauauauaauauauaauauauaauauauaguuauaacacuauuuaauaacuauaguuagaauauuuaacacuauauaguaacuuuuaaaaauuagugaaauaagaacaugcugcuaggucaauuggcugaaaggacccagaaaggcuuacaaagcaggugacaggcuggggacguagcucaguggcaaagcucuuaccuaacaugcauauggcccuggggucaguuuccaguacugaggaaaaugucagugaaugaggaaaaguuacuagugagguugcaugaucugaucugcugcugacugucaaugcagcaggaaaucuguauccgcucuuauccgcucccagaccacccacuuaaagaguccugaacaauaccaagaauccagaaguagcuguuuuaagagcagaucuuauaaaaaaaaaucauuauaaaugugaaaacuggcgccgggcugccccagugaaugcuggggugaugucccauagguccucagagucaauagggcugagaccuugggggagacuaaugccagccuggcucucuagaaauggacgcgccacuacugugccauugcugacgccaagcuguccuucggugaugacauugaacaggcuguggaggaggagccgguccagguggguggagaccugcuugccuucagccuucuggucuuguccuuggagaauccccaccuggagacuuacuguguggcuucucauaccugggcuggcuugagcauccuuagcucuagggcgauauugcuuuggguagcaaagcuuaacuagcucuuccugauuggcuagcuagccuagggcuuaaccaguaagauuugaggcucuuuccugcuuccaauagggucugacuggccuuuguccaaugccagcaauccccggaggguguaggugggaggugugauggaggcgccccaugcccugcgcugcauguucccucuagcugcugcccaucuuuggccuuuuucuugaguagaguccaggccuaguucaggcuucugguacugggacuccugaaccccugccuuaggacuccuggaaacagccaucaaugaguugucaggagagggcagagcgagcuguaauaagcccuuucggaugcuuguggcucaggacacuccccccacggagcugcauuuuggggagaaaugguuccacaagaagguggagaguaggaccagugcggagaagcugcugcaagaguacugugcugagaccggggccaaggacggcaccuuccuggugcgggagagcgagaccuuccccaaugacuacacacucuccuucugguaacgcccccuuccucggaggcuggugggugggaggugguguggucaggcuguguccugccuggcucugaugggacaucccugucucuauucccaacaggcggucuggccgggugcagcacugccggauccggucuacuauggagaauggggucaugaaguacuaccugaccgacaaccucacguucaacagcaucuacgcccucauccagcacuaccgugaggcacaccugcgcugcgcggaguucgagcugcggcucacagacccggugcccaaccccaacccacacgaguccaagccguagguuccuaggauugggugggugacccauggaggugugaccacuaugggguucucauuuccaggaccccguucucuuugacaauguggguucuuagaagucuaugauaacuauucccacuugucagacuuugucccauccucucucucucuucucucuugcuuguucuuuaauaauuuuauuugugcgcucaugcgugagcaagcaugugugguauguacacgcgcguacagggccaacugaagccagaagagggaguugcauccccuagggcuagaguuaaagacagaugugggcugucugccauggauccugggaacugguuaagagcacucacucuuuuuuuuuuucauuucagagauauuuaucuauuuaucuaucuaucuaucuaucuaucuaucuaucuaucuaucuaucuaucuaucuaucuaucuaucuauuguggcuggccuuguguagguacuaggccacauguccuggaaaauuaggucacauggcugcuuccaucuuggugaggucagcagcuaagauggcugccaucaccauggcagcuucuaucuuggugagauguuuucucgaaaauccugggcucauccucccaguccuguaugaacuuggguguccuggcuguaaucccaggacucaguagauagaaacagaaggaucauaccaucuggaccauugccacuccuguucaaaacgagacacuuguuaugguggcuccuggagcucccaugaccagcuucauucuuuuccuuccuccgaguuucugaaucuccacuggucugccaugugccuccggaauccucugcuucguccuccucacagccucacagcaucgcuuuccuguuugccaccauucacugugauuugggggugggggugacucuuuuuuuuuuuuuaagcuaaaaaaaauuaugaguaugagcgguuuugccugcaugcauauaugugcacgguguguauaugaugcccacagaggccagaagagggugucagauccucuggaaccggaauugcaggcacuuuggagccaccaugugggcccuuggaucauaagcgccauuagugcucuaaccacuaagcuaucucuccaguucucaauguuuuguuuucaacccaggguuucucuguguagcccuggcuaucuggaacucacucuguagaccaggcuggcuuuagauucugagauccaccugccucugccuccugaggggagugcugggauuaaaggugugugcagcccagcuuuuuuugcguccuuccuuccuuuccuuccagcuuccacuucucucuccccuccaugauuucuucccccuuucuucucuuucagugcccugaggucuggggcuuugaucucagagaccgguuuggguccgcagugucugugcuugucaaggcucccucuguggucaaaggaaucacaguauagggcucacgauagcaaucacggcaguacguaguacucacgcuaguccguaguacucagccaguacucacacuagcacucacgaucuuuacuuacgauuagcaaucacaaggacgaguuccuuucuccuuucccucuuuuauccgcgaaagagagaguuccaggccaucccuggcaaagaggucaacacauuccagaaauaccaagauaaucguuaagcagguggauuuaacauuuuugcuuuuggaggaagcugaauaauuuacagugacauuauuauuaguguuguuauuauaauaaugauuauuauuaacauuuccuguuuucauaccaguugccuuuccaaacuugucauuuuguaucuuuaguaaccaaaaucuuucugagccucacccguguucccugccccagauguuucccugcgacacugcuguagcucuccagccuuuggggcugggcaggugggcagagaagagacuccccugaguuucaccuugaccuccucauacuccuggggucuugauaaaaacauugcugccuuucuuccagacaggggggcuuauuccuauacccccagcuacuugggaggcugagcugcagguggaucggaaguucaaggccagccagggcuauaugggagggcacgugccuggagugcaugugaccuuagauuaacccuuagugcugcaguaaaauaaagcaaaaguucaauaggaaucacugucuuuggaggugugcaaggucagggaagucacagcaugguuucuguggcaguuucaucgucagccccaggugucccugucuguugguauugccuccugccggcucuccaucugggaggacccucaccagcuuguuuuccucuucuggaugcaggugguacuaugacagucugagcaggggggaagcggaggacaugcugaugcggaucccccgagauggagccuuccucauccggaagagggaggggaccaacuccuacgccaucaccuucagguaggcgugcgggcacuguuuguaccugagggugagugcuccccagaggagacauagaaaggacacgaaugcagccugaggaagggggaacucugguggaagcagagaugccucuccacgaccuugaccccauugucaauggcaaggacagcaauauacagaacugugugaguccacaguaauaggugcaagugcucucucucucuaauagucucuaugguccuucuguuuuaacuucaaguaaccccaggauuuaggagcuaugaccaccauuuuguuuucuuucuuucaaacaaaaauuguauuauuguuguaugugggcauacacguucuauagggucacuugagggucagaggacaguuuuguggaguugguucucaaucccacuucccacguguuccaggcauugaacucguggcccguugggcuugcacgccaguugcuuugccugcucagccaucucacugauaagccuaccaucuuucuuuucuaaggcaugaaaugaggcacagugaggcucaguggcuucuuauagcaugugggggugggggcugggcauagaacccaggucugggcuugcuccccuggcccccacucccuuugcugucucuuaggugugccagauuucaaccccagcaccacacuccuuccucucccacaaguauuuccccagccucacgucagguguugugccgauggcaguagccuguauuacugucucccacacuggcuugucuguggugggcugacccaguuauucgaagugaggagauaguaguucggagcgauuaagugaugggucaaguaccacacagccuuggaguuggcugagcuggauauccaggacacguacgcagccugugccagucuuuccuggaucugcuccaagaagaggcuggggcccaguugagaccugugguggcccuugccucagccugccugauucgaaagaccgagucacuucacucugaaguucauauuuggcagaggggccgucacaguucuggguccauguuucuguagcuuccagaugugcgcagcugccgugggguaucuagugugcugcugcugccccuuuguuuugcaauugguuaccuugucacccugcgccccugucaucgggccuuuucuucccuuccuaccugcacugaggcuucuacucagauaccuccuggaggucauuguuauuggcuugcugaagaccuaccagcuacugugccagcuccagucagagaguccuguguccauguggcaccacugggaacaggggaacagcuggcaggcccugggccucuuuggcaccuguguuguuuauucucucuucuuuagaacacucuaagugguggugcccgcuuagccuugaaggaaguugguauguuuauucaugggcgugcuguggacgccaggcccugcgcaggggcagggaucucacuguuguaguccugucagucaggaugcuuuugucugucagugacugguugcaucuggcugaagcacugaggguugaagguguggccacaagaugaggaguucaggaccgagucuggcucuguguuaucuauucagccaucuacccaagggaugccagaggcacgcucagcccucucagcuagccucgcccugggcucccaggacaggggcuuuuaucucacaucuaucugucugucugucuguuuaucuacuaucuauaucuaucuaucaucuaucugccuaucaucuguguaucuaucuaucuaucuaucuaucuaucuaucuaucuaucuaucaucuaucaaucauguauuugccuauaaucuauuuauccaucaucuaucuaucuauguauccauuuauccauccauccauccauuauuuuuugagauagucucuccuuauguaucccuggcuggccuggaacucacagagaucugccugcucugucugccuccggaugugggggucaaaggccugcgcccccacaccuuuuugauaccagcucuucugaccuaugagagggcuggcuugugguggcuuugguuuucauuuuuagugagguuuaacaguuuccacucgcugguuggccauugaugucuauuuagagacguugcccauuuucugucagauuuuuguuguugcugucacuauuccgucacuugcguuccauaaaucuuugaaccugaacagaucgugaucagaugauccguuugcaaauguucccuucaguucuguucucuucuugaaguccgugacaucuuuggcuauauagaagcucuuugguuuaauguaaucauacuugucuauguuuacuuuugcacucauggggcucucuggcugcuuuuaaagguuugcaccccaaaaacucagcuauuagcuauugcacaauaauuccaaguuggggagugccacguguuugacuuugcuuuuuuuuuuuuuuuuuuuuugcuuaaauuugcuuuggcuguucagggcuaacgucacagaaauaaaaucaaucagcacaugauauuuguccaaauuuguagugugagguuuuggcucauguauguaugcauagguagugacuacagacuuuugucauuucuuucuggugaauacacagggaagacacuugcuuucuaaauuaauuacuuaguuaauuaauuaauuuguguauuuugcuugcauguaugucuguauaucacgagugccuggugccuguaaaggccagaggagggcgucagagccccuggaacgggaguuacagacaguuaugagcugccauguaggugcuggaauugaacccagguccucuguaagagcagaaagugcucuuaacaacagagucaccuccccagcccagauacucuugucucuaaaguuaggaucagacccgauuuuucuuauuuuucuaaaucaauaaggcugaaggaucaguugucuguucuguuuggaaucuuuucugccucuuguuucaaacagaugaaaaaggaaaaaagaccaaaacaacuuaucauccuuuuugaaacaaaacaaaacaaaacaaaacaaacaccaaccauuguaacucugggccacuggaggcaagauucaagaaccugaggacugauuggaguuuuaugcaaggacuggaaagcccuuuguggaagggcccacggagcaaacacuuucggcuucacaggcugaauagucccuguugcagcuauguaaccccaccauccaugagagaaaaugaccacagcauagacacaaaugaacaguggucauauuucaauaaaacuuuauuuaaaaaaaccaaacaaacaaaccagggagcagguuuagcuugugggucauacauaguauggcaccucagucagguugaaagaagagcuggguguugagcaucacauauggguucuuucagaucugaacugaaaagaccccagugucucguguuccauaggaggacugaauucucuucauuucgguccccuaaggacggguaacaaggcuguggcugauugcuguagcugcuagcauccuugguuuguuaauccccugugguccucucccuuaagggccaggggcaaggugaaacauugucgcaucaaccgggacggacgccacuucgugcugggcaccucugccuacuuugagagccugguggagcuugucagcuacuacgagaagcacgcgcucuaucgcaagaugaggcuucgauaccccgugaccccggagcuccuggagcgauauaauaugguagguugacgcccuugggcuuguuagucauaucacggucuacauuuuagagauacaaugugcauacauuuacauauauuacuguaugucugcgauaggagguccugaggaugcagacuuggccaccguuuacaaagacucuguccccaugcgacugauaguggagguugggagaggcaggcgaugcauuagaaauaaacacagacagagucagaugguaauauauguaaagagagagggcugggacggcguagcaggguaugaagagauggggcaguggcuugcaguuuucaaagguucuggggcgaucuuccugaggagugagccaugcagauaucuggaggagaaagaacagcagaagcaaaagccuugggguggucaacaggcaugaaaugagcccagcgagagcaacgcugaaugaugaaugaggcuggggcugagauuccagaagguucauguagggccuggugggccaugggaaggcacuggcucuuuaucucguacacugcaggguccugagugcacagaaggccggauauggucaugauaucucacuuccugucagaaggauccuugauuuccugagaggagacagauucugagggcugguuaguguugcuugucaacuugacacagccuagaaucagcaggaagaagucuuagcgagaaacuuccuagcucagguuggcccaugggcaugucuaugggaagcucucuggauuguucauugauguaggaaggcccagcccaccgugggcagcuccauucccuaagcagugagcccagaacaguaucagaaaggagaaagcuggcugagaucaagucagugaggcuacagguguuuauuuucucugugcucuugacugucccugccuugacuuccucaugacgauggacuaccauccuuuuuucucuuaaguugucuuuggucaggauauuuuaucacagccacagaaaugagacuaggaccuaggacccaggacccaauauuccaaccaugugccagggagugugucuaaauucuuccuugagaaaauuuggguccuagaggagaaagcacagugugccagagugagguguuugggucagcacuggcuccuuuggagcacacugaccuucauagcaagaggagaagacacuacaguggacaggggaguggccaagagaggcgcuuuaacaggacaaaagugugagccaaaaccuaggagacagaagugaacgaauaaugucugaggagaugaggaaagacugacagcagugacucgggguagagggacaggaaggcuggggagggucaggguaggccaggggccuuggcaguugcugcauaugccugccaguuucccugguaugauucucuugagcugcagauaugcuaucuuugaacaggguaucaagaagagauccuggcauccucuggguagggauaggguaucuaugauuuccagguugcuuccaaauuugggggaacuuuuugaaucuucuugcuagcucucccuccgagccacacaagaaucccgugagguuccaacucuucuuuuuuuuuuuuuaaagauuuauuuauuuauuuauuuauuuauuuauuauuuguuauuauauguaugugaguacccuguagcugucuucagacaaaccagaagagggcaucggaucccauuccagaugguugugagcuaccauaugguugcugggaauugaacucaggaccucugguagagcagucagcgcucuuaaccacuaagccaucucuccagccgccuccaacucuucuuuccaaagaacaagauaccccgagaaagccugcagccuggcuguugccacaggccauucuaggagccuggggugccguacuuacuuccuguuugguuggugcugggaaucgaaccgggggccuugcccauggcaggcaaacacuucuuucccugagccacacuccucaagcccuuuccguuuacucuuuguccuuccucuuuuuucaggaaagagacaucaacucucuuuaugacgucagcaggauguauguggacccaagugagaucaacccuuccaugguacggcaccaguccuacccaguagagugagagggagacccugccccgccacuggucuccaccacaguuauaguggggaguauucugggacaccugaccacagcuaacauuucauggugaaggguaggacauaccaugugguuucacggagguuaaucgaauuccauccagauggaacugagucucgcuagagucccgaguuucggugaaccaccuuugggccacacagauucuaauuaaaaaaaucuuccaaaaacuccuuuccugcuugccgacggagcccgaggcguuuaugaauuaugucugguucgaugcccuccucgcgaggccagcgcuaucucggauucccacccugccgcugccucguaacuuuguguaggaaaagguggauuuugcuuuuugccuccagcugcuccaucuccaucucagacuuagugggggaagagcuacagcggauuuucugccugguacacgugacuagggugcggccacucucuggugggcucugcugagaucccggccucaauuccuuuccuuuuuuuuuuuuuuuaaaaacacauuuccaaucuuugguggaugcaacuucaaagcaggccaugaaggcuucagagugaggaggugaggagagaguggcuaacuuguaugggcagcguuucagagggaaggcugugcugugacgaggcccagcccggaugguuagguuugggacauuuucccagcagcccccggaagaauauugagcugaccuccauccuccucccagaguuacggacucaguuugcucugaagggccugcgucucuucuccuuuuaaacacaguuccaugaguuaggucuacuggcucacaagagcgucaggcagaugacacgggaggguggagcuguaaguaugacaucacagccccaccucccaguaccggagauggaacccaggaccucucauaugccagggugagguguaugcauagcugaggugcauuuccagugcccccccccaauccccaucuugacuuuuucagggugaccuagguaaguucacaggacuggaaggauagcauuugggguaacaugucaaguguguugaagacaagaguccaguaugacucuaagcacuuagccuugguuagauccuaauuccucaugccagcuacacaaagcagguaccaucgugugguacccauuuuacuggugaggaaacugagguuauucaggugacuccaagcagcuggguuggaagccuguccucuuggccguguggauacgcccaguuccuacaaggccacacagagauuggcucguuucucacuaguccccuugggccuuuuuugcugucccagaaaagcagucucuuccaaauacuauucaguagaaccucuuuaugccaugccugugccucucucucaccacgagcccggcucuggcucucacauuuagaaugccggggaauaauccugccagucucugguugggguucuacauggcagaagcuucuagaagcugcauuagucuuuauagauucugguggaggauggcaguaucucgcagucacugacccaguucugggcucagcuacuucucaugugguuggcucuggaccagguucuucaugucucugugcucagcuuucccaucuguaaaaugggcaugauggcaccaccuccccguuagagugguugugacaguuaagggagucacuguagguuagaacaguaaguucagggcagcucuccauguuggcagaugucuaagaaaugcagggcacaggcauuuuuuacugucacacgaauuauuucacugauuuuucucaggagaugcauaaaacuuuaauuaccauuucagcuggggaaauggaggcuuagcgggcuccugcuuacacagauaggagugggcagagccgcgguuacaacuucugggacggacuuaguaucuagucucccagaagugaucuuucccgaguccuuucuccuuugucagggaagagaggaaagccaaagaccuaagcaggcuugaucauuuuagagauuucucuauuaguauuucuuugcuguguguggguuuauuuuuuucuuucuuuguguguuuacuauuauugaguagcaggcuucaagaaaauucuuugaaaauuucgccuccauaaauuccaucuuuucuugcucauacagagcccagcuuuuguuguuauuguuguuugauuuagggaggggugugagacauugagacagucucacuguguagcucaggcaggcuuugaacuuuuguuccuccggccuuagcagcaccccaaccaagcucuggaguuauggguaggcaccacuacauccaggucccuagcaugacuagacgauagugucugaacuucugggagaaccauuaagaacugcagcucugagguggcgaguauggauuaaucuaagagauugugucgagaguuuagucuuucuccugguugagcuagucuuuaacccacuuccugguggacugcauguguuugguucccaugcaauaccaacucucaccagcagauggcguaguaacuccggccucugccgucucuggcuuccuaaaggguccugcuucccucugcugccucugucauccaacugccccucuuuucuuccuguuccccccccccaagccucagaggaccgugaaagcgcucuaugacuacaaagccaagcgcagcgacgagcugaccuucugccgcggugcccucauccacaaugucuccaaggagcccgggggaugguaagccugaccggggaugggccucuugggggugaacuugacuggucuccuauuguggugacucuaaggggcuggguggcgcucugagcccucuugucucacauuccagacuggaugggugcugauucaccacggaggucuucccaagguugcaucguuacugugcgggcucuagcaaugacacaagcuuguuugugguuaaaaauuaaaaacaaacaaacuaaaaaaaaauauacacgugugccuauuugucugaauaugcacacacauauaugcagguaccuaaagagucccgacaagggcaucagaacccugggaacgcaguuacagaugguugugagccaccauguggaugcugggaacugaaccuggguccucugaaacagaagcaaagagcuuuaaaccacugagccgucucuccagccucucaaguucauuuaaaaaaaucaggagacccccuugauuccaaacugguuuucaccuaaccccucggcaucaaagccauacgacagcaggugaggaacggccccccucagucuuucugacgacgccucuguccucacagaggccgccugcccucacugauuggugcccuuugaccuucucucccagggcaggcgcuugacauuaccgaggccucucccacucugggcgucucagcugcaggcgcucccucacugucauuuugccccuugaucuagggaauucccaggcacaguuggugcccaggggaagagaguauguguagaaacccccgugagaacucccaagucacacuguuuguuuguuuguuuuuugcccggggaagacucugacaugucucaugccuccccgugguucuaaugugaacuuuccuaaaauucuaacucuuguuugagaugaacugagagacaaggguacagucaucuggcaaggggcuguggguaaacggcagcugccacccaucucucucucucucugauggcaagcccgucagucaccugcuuguaucagauccugcucccaaacuacucagggacaaccaaugguuuuugucccgguagaaacacuuuugagagugaaagcaagguggacauuagugauuacaugucaguaacaauuaucaaguucuugguccugaaauacagguggcgcccaugcuuaugaugauucauagaaaggaagguggugaggagggugcagaaagggcuggcacuuggcagccgcuaugugcacaguaucacauauccuuacucugcuuguucaggccaaagaagcaaauuaggugcuuccugcuacugccggguacggauuugguuauguugagaaagaucucaggccguguggaaggcaggcgugugguucuaaguuagggguaaggugucuguuuaaacaguggugggcacaggggccagagaggcacagaggagcagcugccagggcucucuggaggagaagguaccgagucaggucuuagguaguuaggaggcuuaguuagcagguuaguagccugcuugucgggcccagcagcuaggcagugcagcaggggcaguucugggucguggagcuucccugggcugagacccaguugggcuaugacaggcuccugaggcuggaucuugugggaucuggaaugcugcgacaugguguggcuggagguacuuuugaaauaagccuucuggucacagaaaguggaccagugaguggccuugaaaguaugagacccugcaaucaggaauagacuggagguguguaaguguccagcguggccacagcacauccacaauggguuaugucgaauguggcuggugcuguaaugaggggcuaggccagugcucuauggcugagcauucccucacccccacucagccucucauuggcagagucugggcaagugccuacacugagcugcauacugagccaaggauggacauugucauaccugggauggaugccggaugccacuugaagcacuugguaaacccagacuguucuaauaaaacccaaggcagcuccagcauugccccaauuuacagauggggagccuaugguacagagcaccaguguagucacugaaggagauggaauuucuuuuagaaaaguauuugguuuuauuacuuuaaaauuacgagucaacauaggccugugugugugugugugugugugugugugugugugccugccuuagaguguagugcccacagaggccagaagagggcagaagauccccuggagcuggaguuagagcuacuugguauggaugcugaaccaucucuucagcucuaaggagcuaagauuucacugcaggccauuuggccccacacacucuugugucuggauucacagccuucccacaaauggcgugggcgcucucugagaggccguuggucccucuuaaagcccuggaagcuuugacaucucuuaguguugccaacaccagaauuuagucaugaggaacgaguucuuagucaucugacaauaaguauuuuuaaaaggcguaugcuccccuugaaaugcugucaucauagaucaugacagccccucgggucaccugagcacucagagcugagcaggcuaagcccuccauggcugugguucuccacagguggaaaggggacuacgggacccggauccagcaguacuucccguccaacuaugucgaggauaucucggcaggcgaugcugaggagauggaaaagcaggugggucuccguagucuguggugaaggcuuugggggagucccuugagcuaucuuggggugggggugggggugggggaugacuuuaacauauacuuggugggggggggaaggucucugcagagcugggcaguggagcgggcagggugaugcagaaauugggaccagcccugagcugcugcggguaaaagccuccgugacgagccgguuguguuuuaaucaggcagcgcggggcuaagauuuugaaagcucaggagaauucccacuggagugagaguggccagacggggaauuuguccucugcucaaagcaaugugcaaaugaaacacauucgguuuagagaggcagacaugcagaacgugcuuagcaugaggaaggggcagugcuuugcuggaaggugagacagggccuucuggugacuuugccugugagccaggcuuugguccccagccaccuuguauuagagugcucuugguggaagaaaggggccacuugggcucaucagcuugccccagggaagaaucuguagugugggcgcgcaucccuuuaggguccgcagcguuuauucccuaaggguggcaacacaauuggggaagggcuuucuggaggaagcaguguuugagucuuaaaagugaagcuggguuaauuaccaagagaugggcacaggaaggcacagccuaagucagggugcggugaguggaagacaguuguccccagguggcugggacagggacaggacuccucacugcaucugugugucaccggaagccuggcagagaaggcuggggcaguauagcaauaauaucagcuuugccuucucaguugguucucaggacggacgguucgagugugcagcacagaggggauaaaggccggcgagguuggccagggcuuggaaagccacagaagccagauggcagaucccagcuguagcuuuccgugggacguggggggagccgcagaaguucuccugagcugcaggagucgaaggccaaguggccucguuucauaugcacagcagauggggcuugagauugguuuuaggacucacaaggugugucucuguggacuggaaaaacgcaacacagauacuguagguaucugugcacugcugggucuccgucaucgcccuccccauggacucuguaaugaaaacgcauuuuaagccacgccacagguaguggcggcguggcgcuaaacggcaugucuagaaacugguugucguuuuauuauuuugcuuaugacuacugagaaucgggucucauuucuucacagauuauugaagacaauccccucgggucucucugcaaaggcauauuggaucuuaauaccuacaacguugguaugugcacuuguuuucuuagcuugauuccaggccagauccaccccgcccuaccaaggcuggcuuaaggacuagccucagcagggaggcgggcuggcgcaugucuugugccuaccagaccuggaugagguggggcugaagcaugcauggggacugauaggucccugaugguggggccugcugccaccaucugcuaacacaggacugcccucuaagaaguacuggugacuuggcuguugucauggugucaacaucugcccaugugucugcuuuacagagagcugagcugcugauuggucaggguuggguacgucagccgcuaaagcucccgaggcucuugccuggcucuucucacuagaucuuagcucccgcaagaaaccuguccugcccugguuagcaugugugguaacagggacguggcggggcauucuguguauagaugagccgugauuugcacgcagcucuguguucagggccugcccacacugaugugggugcacgguagcuuccagggauguagcuuccuauuuguagcugcagguccaagcacagagcccaagcucccuccacgguggcccacugauucuugagcugaguccccucuuucccggggagguccgagcaugguccccuuggguuccuaugacaacaaucccaggaccgauacuccugcccuuuuauacaaccauuacuuucuuuccauccuuauucucuucucccuuuucccuuccugugacucugguagggaagguggagggguuuugcuccagaugagaaaauggguaagucucuggcaacuccccgaugugccaggacugucagacucaauucucaccuuuguagcugaugcccuggcuugcccccucccuguauuguccuguuagaggacauggggaugucgcucacucagcaguagggacuugucaucaggguggagcuguccuucagcucugcccgugugacuucgcacauguugcugucaccuugagccucucggucuugucuccuauaggaugagugucacaguguccccgugagguuugcuaaaagcuaaaaccacacguguagucgucugcuggggacgucaccucagagcucagaaagugcagacaccaguacggggcagaucaggguaaccuucauguuccuaucuauaguuaucuuuuuuccuugucaucugucagucagccuuagugugccacagcguuccugacuuuccuucauccucauaggguugcuuucugggucuggguucccacaccccauugucuuucucuucuagggauguuguuccuuggauuuaagguugaucuuaugucuggcacaucuuuuuuuuuuuuuuuuuuaagauuuauuuauuuauuauauguacacuguagcugucuucagacacaccagaagaggucaucgaaucccauuacaggugguugugagccaccaugugguugcugggauuugaacucaggaccuuuagaagagcagucagugcucuuaaccacugagccaucucuccagcccaggucuggcacaacuugagauaguugguacaucuacaaaaauuccauuucuaaauaauguuacacucgcagggacaggagcuugauaauucuuuuuggaggauaauacucagcccgguacacaccuuuaccaguaacuuguacaaaagguucaagacacugccugcaagaaggugggaguccccaucagcaugugacuauagcuguggcaguugaggugggggcacuaguaugaggugcggucuugguggucaccuccugggcccaucaggacuuuccuuacccucugucuacagugaaggccccccaggggaaaaaccagaaagccuucgucuuuauccuggagccuaagaaacagggagauccucccguggaguucgcgaccgaccguguggaggagcuguuugagugguuucagagcauacgggagaucacuuggaagauggacaccaaggugggucuaagcacacuggggagcgagguaccuacccaucccagcccauucugcccuggugaggccagggauggguucagaggccauugcuguguuucaaagggacccugaauucuaaacuccggggcuggguacaggcaucagcuguaaucugguggccaguggugccagaguucuaacguggggcaggaaggguaagagaggggacuucaguguggggagcggguguggcggcagucccaaaggcgccagggacugcagcuaagucauaugacuugcaccugacuuccucauauaaaccacaaacaucuugagugcugcgcagguguaccaggauacaggugaauccaauuugguggagauuugccccugcugcccugauuagcugaagcugcaugccuggugagguggcguggccugcugugcguggaugggaacugagaguauaaaagagugagaggcccaggguucgagggagauauaaacaagggagauauagagaaaaaaagaaacaggacugaauaaaggugugcagaaggauccuguagcagcgucguucuuccuggccaguugagcgcgcgcaacacuucaggccaggccaccagcuaacaaaucuggucuugacauugucuggcuacauggcucagagcuggaggcaauucugucucuugggauguauggaccaaucuagacaacaucucuaaagagcucagcguaggaugcuggaagccagugagcuccuagaugcugacgcucuuguaaaagcauucugucagccauugccccggccaacgaaaggcugaagagucuggagcagugcgagaggguagcucugugugcgagaaugagaaguuaacccuuacccgauagcacuguacagugcguguguggagcggaguccucccuccccagguccauguguguggccugagccaugcuaaggagacagcugucuguacugggcugugcugggggagcuaggagaagggggaggcugcauagguuucaaagguagagagaaaagagaugauguuucuugggguccacagagguuuagaguacugaguccuguggaccaccccaaccaguguggcuuuagggagggggucagacaggaggcaggggcauaaugggaugacagaagcucccucuucugcuaucagggucuccaccuacuucagauugaccuugaaccuucaaauucuccugccucagccagccaagcacugggauuaaagucauguucuucugcuuguggcucuccauuuaccauuuauuaucucugugugugugugugugugugugugugugugugugugcacaugcgugugugcaugcauggaggccagaggaggguguuagauaccaucuuuuaucucucuuccccuuauuccuuugaggcagggugucucccucaaccuagaccuuaguuuguggggucacgcuggcaacagaaagccgcagccaccccccugccucuuccccacugcuguguuggaguggcagguaugaaagaccacaccuggcuuuaucaugugggugcugggagcugaacucagguucucuuggugagccgugcuaaccacugggacguccccccaguucacgcccgugugacuuuagagagcagcagcggcagagccauccuagacuccgagccccgggugggaacagcaugguggagaaucuaaagaggguagaagagaggggagauugucuucaggacagaaaaacacccaacccugggugcugggggaucuggguggaaagcuggccaggugaguggagugugccaugguguagaugcuggcucgguacuguaguguguucagggagagcuggccaggugagccagagugugccaaggugcagacgcuggcucagugcuguaucggguucaucucuacaggagaacaacaugaaguacugggagaggaaccaguccaucgccauugagcucucggacuugguuguauacugcaagccaacuagcaaaaccaaggaccauuugggugagucuccuggggaagacccuucccagcgaacucugcuguuugccggugaggcggguacucucaggauacuacauagaacaugcacuuugcuuccuaacggauccaggcagcagcccuguccauguucccauagccaagauguguuggugguucuaaauaagacgugaaauucuguuaugccuagaaagaaaggcuguggggagaaucgggucccuuuggacugcacaagacccucuuuguaaugcuggacacugccaagggcaagagguaccaauuaagguguguaaggugugacugucaugccccuuagguaucuuuguguaugugugugguaguuacuccccgcacagucaggccaauaggccaaccugauccagacaguuccucacugagacucucuggcugcgugacuuuaggucaugucaaguuggcgagaaacacccaucauggugaguguuggugcaucuuggcugugguuccucagcuguccaucguguuugagagaggcucugucacugggcuuggauucagcaagcaggcuaggcuggcugaccagcgagcucuggggauccuccugcaagccugcauacugagauuacacaguaccauaccuggcucucuucucuucucuucucuucucuucucuucucuucucuucucuucucuucucuucucuucucuucuccuuuccuauccuuucuuuucuuuuuuucuuucuuucgucuuucuuucuuucuuucuuucuuuuuuauaacuuguggacucgaacucagguuuacauaguuggcacuuuacagaguuggccaccacccuaucccuucagugucuuuucuuuuuaaagauuuauucauuauuauacauaaguacauuguagcugacuucugacacaccagaagagggcaucagaucucauuacagaugguuaugagccaccaugugguugcugggauuugaacucaggaccuuuggaagagcagucaguguucuuaccugcugagccaucuugccaacccucauggccuuuucaagagaguucuggucucuuuuugucaccugggccuucugccaucacauccagaaguaugguugacugucuccucugucuuagucagugcucuauugcuuugaagagacauaaccaugcaacucuuacagaguaaaacaucuaauuggagacuugcuuacagguucagcgguuuaguccauuguaaucagggugggaagcaugcaggcagacuugguguuaaagaggugccugagaggucuacaucugcauccucagguagcaggaggacagagagagcuauggggucacgcuugggcccuugaaaccucaaagcucaucccugugacauacuuccuccaacaaggucacaccuacuccaaugaggccacaucucugaauagugccccucccuggugaccaaguauuuaaaucuuugagccuauaggagcuguucuuauucaaaggaucauauccucucugcagaaaaucccgacuuccgagaaauccgcucuuuuguggagacgaaggcagacagcauugucaggcaaaaaccugucgaucuauugcgauacaaucagaagggccugacccgagucuaccccaagggacagagaguugacucuucgaacuaugaccccuuccgucuguggcugugcggcucccagaugguggcacucaauuuccagacuccagguaagggaugaaggcagccagucuguccaggcuaggugguggcccugucauggccagcaaugucacuugggcagcuagugggaugugauuguuucugaacaagugacugggcuggcccgucaagguugaacuuggaugcugguuaguacaaggcccuagggacugacaaaggggacaguggacauauggcugaagcaggcucggugaccacgagugacagagagguauuaugaccauucugguuuaggaagggaauguaauaacuuauugaacuaguaaguguuguuuuuaaaacaacaucccaaacaucugauuuaccaaaugaagacucaggagcaagaugcuggggugaaagcaucuugcuagcucagagaggcagagagagcacccagcugacugaugccccagaaggaaaaggcuccuucuccauguugucuuaaacacccuucaacucacagacccucuucuccuucuccuggcuucucuuauguucacucccugucaacugguugcuugcuuugccucuugaccuaugguugauuuaauuuaauccucuuuacacaaagcucuugggucaaaggugugcgcuagggcugagccacaccacaacaagaaaagguuuuuccaguugacaaucucggggcuuacagugugaucaaauauccugcaacagguagguaagucucagagggacugauggauccaggugugacuggauccaagcucucaguggcugccuuaccucuuugugcgcuuucucuccaagggcuucaugccuacccucucuagacucuuauauaguugggaaaacccacgcacacaaauuuuagacguugcauccugugaauucguuuguucguuucucuuauuuauuuaacaacuacacccaccucagcucuaggaaucuguaggucaggucccaucccugucuaccgcagaugccacugccuccuggacccguggcucuuguucccaagagugggugcacaguguggggcagacauuucuuacugcugaggaauccucccccuagccaacccccggaccacugggcaccuguguccugaggcacuugcccaguuccuccucuagagcaugggcacacuccuucagcauaggucacuacuguaguuucacgaagcucaccugcucuuggcuccucagggagaaaacugacuuguccuuacaauuucugcucaaggcucugcucuuugaguaacauuaacucuuuccccucucaccaagucaagggauguuugccauuuguuucccugcaaagcgguggguccucuugguaucccaccaagcuggcuuuuuauugauagugcuaacuaucuaccuguugugugaacugagauuaugugugggugugcuugccaugguccacacgugauggucagaggacagggcaugcgugccaugaaacaugcguggaggucagaggaauagggcauacauagauugcacacguguguggagguuggaggacagggugcuuaugccaugguccacacuugaaggccagaggaacagggugucuaugucauggaacacacguggaggucugaggacagcugguagagucuuuccuucuaucuuuaugugauucuggaggccacacucaggucgguggcuuuaucuacuugccgagucaccugucccuugaacccugugauuuacccugugguguaagcaagcguucuaccccuggccugcacccaguuucaguagauucuaauuccuuaaggcuuacaccucuccagacucccuguaagaugguuuccuggugcgggauucuuuccuaacgcuccccauguuucccuggagucagaugucuuuucugaaccgcuucccccccccccccccagucagugcaggaaggucacguggccugugcccaugugcgcccggagcugguguucccuggcugcccccacagcgcccuucggcucucuuuucagacaaauacaugcagaugaaccacgcgcuguuuucgcucaaugggcgaacaggcuacguccugcagccugagagcaugcgcucugagaaguaugauccgaugccccuggagucccagaggaagauccugaugacacucacugucaagguagagggggcucccuggggggcgcucuuguccuguuaauccagcaccaucucaacugcaaccucaugugguucaccuggggucauucugggcugaaaacccuuccugucacuugcccuagucugggugugacguaugcucuugggguucaugugaggucaaccucuagccgagaggagaguucauuucuccuuugucuuagagaggucacagcuuacucuuucucucugucugucucucccuuuguuucucccucucugucucuuguuucucucucucucucucucucucucucucucucucucucucucucccuuccuuccuuuuuuccuucuuguuuuuuuuuuuuuuuuuuuuugagacaggguuucucuguauagcccuggccauuguggaacuugcuauguagaugaggcuggccucaaacucagagaucugccuaccucugccuccugagugcugggacuaagggugugcgccacuacugucuagcaugaguuuucuuaaauucaucccguccuuggcauuuuaggcagauaugagagaaaguguuccuaagauccaggaaguuaaaaugaaaugagcugggagguagcuuagcuuuuggaguguuuauccagugugcaugaagccaccgggagcaccauggagacaagaggcaggaggauugucaucaggguaaggccagcuuuguuuacauagcaaguuugaagucagcuuaggauaaaugagaccucauuuuagaaaaguaagacaaaguauuugaagguguuuaguaaauaagggucaguuauaaacagaccacccuaccgucuucugucugggaaauccaguaugaaggucccaugaaccuguacucaggugagacucuacuggugagucacauggcccgggaacccacuaugucuuuuuaucaucaaagagugauggugggcugggucagcauccaugccucugagagcaguggugacuucuccacugaauaaggguagcuuugaacuuguacagucagacuuuagggucccgaaaaaaauccacaaagcacuacucugugguccaaauuccacccucccagcgcagacccgggagacuuccaacccuugccuucugugucccagguucuuggugcacgccaccucccuaaacuagggcggaguauugccuguccuuuuguggagguggaaaucugcggggcugaguaugacagcaacaaauucaagacgacgguugugaguaaguagcgggugaucccuguuuguguggguguguccaggcagugcagaggcuggaggugucuuccucagucguucccacuuuagguuuugagacuagugucuucucucugugaaccugaaccuucuccguucagguacucgggcuggccaggggggcugcagugaucugccaguguuucccacugccuuacauauaugugcuugguuuuacauggaugcuggggucuacccuuggguuguccuguuuccuacagcgggcacuugacuuaagcaccucugcagcccuguuagucuuucuuuuuuuaaaggugaagggagcagaccgauacguggguuauggcuccuuggugauuuuuauaauguacuuuugcugugguguguuuuccuuuccgagcuccagccugugguuggggaaacagagccaccugcccagggaacaacuuaggugcagaccaagucagcuggccuucucuauaggguggcagguuugcugugugucuugccuuacaagggugguucuccacgagaacucccaacaggcuucagagacacccccccccccaucccacuuuccuucucaggccaagggguccaucagcucacacguguucugcucaccucuuuucuugguccucucccccuugaguuccacucuacaguucucugcuucccuucaccuaucccaggaggagagaugggugaggucuccuguuggcucugguccuggaaggcuggccugcagcaggauugccugcugcaaaagaaauaaccaaagcuuauuauuauuauuauucagggauucuuagaccugggcauagaugcagaugcguaugcaaguuuguggagagguucaagcugaggcugaagagacuggcuuaugaggaggcagggcacaaguugcaguaagcacaagcuuuggucucuuucuagaugacaauggccucagcccugucugggcuccaacucaggagaaggugacauuugagaucuaugauccaaaccuugccuuccuacgcuuuguggucuacgaagaagacauguucagugaucccaacuuccuggcucaugccacguaccccauuaaaggcaucaaauccgguaaggagcguuggcaaggauguucaguuugggggagcccaguucuuuggucugugcugcuggcuguaaaaggaacacaccaacaucuuuccugguuuagaguaagucacaacaaagccauucagaaggguacuaagcacaggggcgggagggggggguggagaaaggccgaauccuuucaacuuuggccucuuugaggaaaccaucaauguuagacuaucuucaaccuggcgcuguuugcuuucauuuugagaugccucgggcauuuuaucuucauuaguagauggagaaauauguucuaauaugagcaagccaugcaugcccuuggccugugucaucaggacgaggcccuaagcauccaugggguccaaguuuccuaagcaucccaaacuuacugucucgcacuagacuuggaggcugacuugcuugcuagguuuauuuuuaugcugaacacaauacaacccccucugccauuaagccaaagugggucacguaugaacccguuaauuugggcaucucucagcacccccccccccaucacagaagcuucuugucacaggagaugauaauaaauacagagagaagaagaccauggagaucuuagaucuagauauaucaccucccuccccaaaaguucagggagcauugaggaagacagaacagaaaggucaccagagcuacagagguacacacagcauaagaccaguacaagaacaagccaguccaaaccacagcccagauaaggggagggcucaugaagccucacuccacgaugaggagcuguuagcaaccgauggcuauugggagaaggagcaccccaucuucuucaggaauuuagccccugggaggauacccagcuccaggagauggccccacauuuacaccuguccuugggaggggaaaacagugaugaagaacuaggggauagauuugaccaaagcacacuauaugcagauaugaaauucccaaacaaacaaacaaacccaugaaacaacaaaacccacucuauugaauuuuuccagggcagcuaagacagugucuugugagaccugggguuucucugaagguggcugucuuagugaggguuuuacugcugugagcagacaccaugaccgaggcaacucuuauaaggacaacauuuaauuguggcuggcuuauggguucagagguucagcccauuaucaucaaggugggagcauggcagcauccaggcaggcauggugcaggaggagcugagaguucuacaucuucaucugaaggcugcuagcagaagacuaacuuccaggcagcuaggauaagggucuuaaagccuacacccacagugacacacccaccccaacagggccacagguucuaauagggcuacucccugggccgagcauagacagugacuauucuuaugugggaugguuucucucaggaccuuccuccccggauuucacauguaacccaacacgcagaccagcuaugugguggauuucuuccucauccacggcauugccaguucaugaggcagacaccguagauccuucugaauuccccaggaggucacuguucccuuguuucccagagcagucauuuuucaagagaaagaaauuacuaucauuuuuugucauuuaugucaaauuaccaucuuuugauguuuggaagccuaggcucuauucagugcugagcugggucuuuugaaaacuuggaccacgccaccccuucuuucaugaagucucucagcuucuguagccauuuuucccacucccugcuagaugcauuuccaaccagcagaugccuuaggggcuccuguuugaaaaugcugauuucuggguccaccuugggaugcuccgauucagcccaggguggcgcucgggaaucagccuguauuauggccagcucccugggaggaccugggcaguacugagcuaaagaggcuaguccccagcugccagucuuacugcugagggcccagacacuagaggaagagucugggaaaauguauaaagccucagauuucuauuuagcaauuuagaaaucacauuugagcaugucagacaacaacaacaagcacuccuugaugguuaacauauaugacaggugacuuuaaagucagcaccugagcggcuggacgcugauuugcuaugugcuucuucagauuagcccagcaaucaggguucagaggcgaugcugccucuucacaucaagaaaagugaaucuuugccguucuggucuuaaugaccucauggcauuaaggaaccagggccagcucguuucuggaccaccuugucccgccccuggcccuaucauccuuugggagauggggaggugacccucaggaugcagucagagcucaugguacacugacuuuccuuacugggagggaaacaauuccccuaagaugaauucgcuuggagacugagaagaaaaacccagcaaggaaacauggagguggauuaauaaugggagccuccuccccguucuaaccaggagauaaucacagcacggcucuucucccucgccuugcaggcucccggcauaucuauauucaugagaggcaggaaauaaaaugaauaguccuuuugugcagauggcucccagggccgucuaaacucgaaaauaaacuuugcccauuguuaggguggcugcacuuaagccuucaaaccggcugggcccgacucaggagggagacaaacuuacaguacucagcuaccuuaauuuccuuuucuuuaauccuuacaauaauccugugagcuagcacucucucucucucucccucccucccucccucccucccucccucccugcagaugugaauucacucauucaaggucacaggcuggcacuugcccccuuguuuuuccuucucuguagacuguccuugagggaccucuucuuucaagugggcacuuaaagccccagggcaggccuuccuucacuuccuuucuccacgugaaauaaacaaaacuaaaaauaauacaauuuucaugguuggugaaacugagaaauagcuuggcuuuaguccacuaguggcuucccagaguugggcaguaaguggaaauaugagggacuccggccagagcccauucuuccuagcucaagaggcacacacccucagucauucuugcccuaaagcuggaguuuauagcugccuagcauuguccugggccaccccugaauaccccaaggucuaguuuauucucccaauccaucaacacuaaacucuccucaggucggccauuaagaugcacagaaucugugucuuaacaggguucacaagggguuagagcacagaaucugcauuugcaucuuaauggaagucacaaacuacauuaaucuagaccaguauuaugcggauaucuacagacagucugugauuaucaacccacacagaagcuagagcagccaacauaccaaacacugccuaaagucucaucagucaucaggugggaauagguuagacaauuucagcacagcaguauuuaaugaacucagaaugccccccaaaugcuauggggugugugugggggauguggccugagaguuuuauaccuaucucaacuaucacacaucuauaaacucaaauccacuuaaaaugcacaauuggggauucugugucacaugagcacaagagaacaaagccagguagcuaagacaugcacaaggaaguuaaguaaaaaaaagacugggagaauugagcaauuuaacaguauguuuguuugaguugggcagugguggugcaugccuuuaaucccagcacuugggaaacugaguuugaggccagccugcucuacauacugaguuccaggacagccagagccaauauacagagaaacccugacuugauacaacaacaacaaaaagccaaaucaacaaugaaaaauauacccaagccuuucuuuguggagaauaaugguuguaauaauggcuuauuuccaagacgcccugaaacagggaguuguuacuuuaucgcucaauaaaacuuuucuugcucaugcucuaaaaaaagucaacaggaugcaaauguucuauacauugguauagaaacaauuacaccuuaaaaauauccaaaauugggaggggaaaaaaagaaggaaggcucaggguuggguggcuauguccuuuuccuuauccuaagcaguagcagcagcagaggagagauucaauagguauuguguaaaggugggaagcuggggcuggugagauggcucagcagggaaaggugcuuguggccaagccugacagccuagguucaauccucacaugguggaaggagagaacacgcuacauacacuacacauaaacaaauguuaauuauaaaggugauaggauaauagauaguguagauauucccuaagaguaugggccaacacagggaugaaggaugguguaaggaaauggggugugucuaaucugugcagcucagcagauaccauauaaauaaaaagcucugggaacaaaucagccauuagaagggauggcuaagauggaagguuguaugaaagcuacgagggaccaugcacugaucugugcuuuuuauuuuuuuaaaaaaauaaaccuauuguaaaaauucaaauaaacauuacacacugaaacagaccucuuaagucucuauaucaauaagcuuuuauacaguuagagcagccauucuguagcugcagcuucucacuggaucuuacacuugcacuauucaguguuuuuaugcacuucuccgcugcccaaaccaaaaaauucaaaggacguaauuagaacuagaaaacccauuagcuuuauauugucuuucguaaguugugucuguuaccugcagccaguccuuguuaauugccuauuauuuagccuuucuugcugucuuuccucagugauauaucguauccacacauguccauuuguuuacauguauaugucuauuauuggcuagggaucuaugcaaaaagaaacacuaacaucugcuuagagaggaaaggcccuucacagugcugugcuguaggcuagggagcagguagccuguuuucuauggauuccuuuagacaagccaacccaucagcuguugagauggagcccugcaacugcuguuuaacagggcugggggugcggaucugcucaagcucauccugcgccaauccucaauaaaaagacacauuucaagguccgcugcacguggacccugauuguaaguaggaagugggcuccagagagauugaucaaugcagccauagacagccauagacugccaagggguagucaaauaggaaaucauugaagauaaaggcgacucccuagcccugugcuuugggaaggcccaagagaaggcaguggguugaagacucauuaccguucugacucuuuugacuuuaugaguacuuaaggaauuaaaccacaauaguaucaaucacucuaauuucaauggggagggguaagucuguagauucucacuucuuucuaaaauugcauuuaucaguugugccuuuguaaguacguguguggagaguuguaucucuccuuuccuaugggacccggggugucaggcauugcagcgggcaccuuuaccugacgagccgucuugucagcccaguuuugauuucuuuugagccaaccauuucuaguuggcagauguuuuaacuuuacuauguggauguguucaucaagaacacuagucucucucuguaacuuuaggacagaaacuugggcauggcacacuggccucucuacccuuagaauggggaugccaucuccaggauaucacaagaaagcccagagcugaugcugauggccugccauuggcucuucuccuucuguuucugcuccaggguuuagaucagucccucugaagaauggguacagugaagacaucgagcuggcaucccuccugguuuucugugagaugaggccaguccuggugagucaugggcccugaccaguuggccaggggugggaauauaauggaaauaaauacucuggauuaaugagcugaaacccuucccaggaccagucaagggucuggguuuuuccccucagcauccuuucuugaggauugcugaaggauucuggagugggcuguacagucugcggggagaggucuugggaaggaguucuuccugguuacuuggcgccaacagccugggcagaugaugcuuuuccaggcaagcuccuccuuucuggauguguuucucaccuguuggccuugggucauugcuucaaagggucugugugggggaaggcuggacucugauucccaugggcuggugacucucugcacuggagggaccuuuguucuaguccuguuugucugugucuugaagaguucucguuucuccuuugacuaaccagcuugguugugcguugaagucacuuugucaccgugacccacacaagaagcaccaucagggaggagagauuguuuggcucacaguuugaugugagacaguccacuuuggugagggaaguauggugacgguggcacuguggugggggaguuuggacagcuucuugcagaggaaucaggaagcaaagacugcauaggaagugggacugggcuaaaaacuucaaugcucaccauugccaucagugagugacucucuucuuccacagcuucaacaccacaagguggggaccauauuuaaacaaacacaugucugugugaggucauuuugcauucaaaugguaacauguaaauguggugggaagaucuuggcuucacugaaagacaccaaagagugccauggacuuagacuaggcucucauagcugguaaccuguguagcaaguuuuuuuuuuuuuugucucauuuuucuuucuuuuauugaaauuagauuuuuuuauacaauauauucugaucaugguuccccuuccucaacuccucugacauuccccuaucaucccccccaucagaauccacacccguuccauucauuaggauacaaguagacaucuaaaggaugauaacaaaacaaaagcaaaccagaacaggauaaaacaaagaaacugaagaaaaauagccaaaggaaaaagaaaaaagcacaugauauacauguaggcacagagauacacauauuuguaugcacaggaauucccuaaaaccacagaacuggaagauaucuaucuaucuaugcauauauacauauauguguguguguauauauauauauauauauauauauauauauauauguauguauacacauauauacauauacacacacauauuauauauaugcaaaggauccacguaagguuaaaaaauuuucccugucaaaagcguaugagacaaaggaccuucaaggaugucacugauuucuucuguguuggcuaacuacugcuggaccuggggcuaacccuuaagagugguuuguauccucagugagacaacuggagauagcugcuggguccacuucuaucugagcugggacuugaucuggugcagacccgugcgggcccugugcacacugccauggucuccaugaguucauaugugguccuguuguguuuagaaggccuuguuuccucagagcccaccauccuaacugggucuuacaagcuuuccacuucuucucccacggucuucccugaaccccgaagggaaggauggugaagacaucccguuuaggacugggugucccaaggucucucacccucugaacauugucuagcugcagcuccuucucuguuguuguuaucauuugcugaaggaggaaguggaguaacaaauacuaagagucccaauucgggcguuucuucccuacuuuagaccacuuauguucccagaugaaagacacacacaaccucuauauuuuuaaauagccuuaggcagcacaauaacugggcagcugcuuacccuccaugucauuagaaucuacuuucuuauugauaacuccaaguuaucacuauuuacuauauauuucaucuagguugcucuuaacccaagagaacccacuucucuuggcccuuagccuauggcagcucuccuccucccuccuguauguucuuuuucuuccauggugacuuauuccugccuuuccuccucuuugugguuccccuguccccaagcccuugaaaccucaaccccaccaauggcucuucugcccaacuauuggcugucggcaucuuuauucaccaaucagaauuaacuuggggcuucgugcagacuccaggucuugggggccuacacuuagcaucacaauagacaguaauagagaaaaccucaccaggaagcuucuuugaggauggcugagcaaaaccugaucuguaaauauagcagaaugucauuaggagcuauuuaugacuacauuccuccuguaguaucugguuucccccgagaucccuggccuaucugcucuccaguuuuuggcuacccaagcaguguugggaucauggagugaaccuuaacucaaaucagauauugguugguugcacucauaagcguugugccacuauuacacaagagcaucuugcagguuggucaucauuauagacagaagacuuuguagcugggcugguguuuacucuucuccuuuggcagcacgcagagggcuucaaguaucaugaacacuaguccauaggaguuaaggcucuagguaggcaccggcuccacuugucuguguucaaugggcuguauagguguaauuuucagcgauagagccgucacaucaguuuguggagaacaauuaguagccuuggcacuagcccucauuguuccuaugggguauuuuuggccaacuuuucaauuagaugugacccguucuuggcacucacuggaagcaucauuuggugaugagagauguccagaugggccuccaucuuccacaucauuuggcaacuucauucagauugacuucauauauauauauguauauauauauuucacauauauauucacauauauucauguauauucauauauauucauauauucacauauauauauauuaggaaacuucuauuguaguuaacuauauaacuauauaacaccccuuccauggcccuuaguuucagcccuccucauauucccucugucaccuccuucccucccaucuccauuuguccguccugcuccugcccucccucuguaacuauauauucuauucccccuucuagggcgauccauaucuccccacucccacccccuuucccucuauguaaccucugugguuauacauauuauaacuuaucgaagacuuaauagcuaacaccacauauaauacauauccuauuuguccgaguguaaaccucacucaagaugauuuuuuucuagcuccauccauuuaccugccaauuucaccauucauuuuuuuaaauggcugaguaauauugcauugugcaaauguaauacauuauccauucacccguugauggacauuuaggcuguuuucaauuucugucuauuaugaagcagcaaugaacacgauugugcaagugcucuuauugcaaugccuggcaugcagauaauucauuuuuccaugacccuucauucuucuaccaaaaccucagaaagcuugccacgagucagggaauuuuauuaccccccccccacucauuucccauugggaaaccuaagccaauuguggcccccagugugcugccauaugaugaucuugcuauuggaccucauuguguuuucugguaggggaacuguuggccuguggucuucuuugggcuguaagaauuaacauguuggcaguuucuugauugucaguuccuggaacauagcugagagcuuuccaauggggcaggaguggcaggacugggagacgccuuuuacagccauugugguaauccagggagugaaaauugcugcauuuauagccaggcaugguggcacauaccuucaacucuagcacucaggaggcaggggcuagcacaugucugugaauuccaggccagucuggucuauauagccaguuucagaccagccagggcucuaaugaaugaaugaaugaaugaaucuauccugaacuugacugagaguaacuuggcuuccuaguaugaugguuucucaagcacucacaaaacaucaggguuaaagaggacauaaaaauauaggaagcaaggcaggaggcagagaguaacagacgguagguggucaacgacccagucagccaaggguaccaccacccucuaauguaagauagccucaggaugaggaaauucuaucugaaggggauagauaauagaauaguuuccaucuugaaaauaauuuuaaauguuaagcuaaaaaauacaguuuucacuugacccuucaguggagacccccuccagccaauuccauguuccuucugugguagaaagacccggacaggaaccuuuuuuguaaaguucccuccuauacuguggcugagugagcaaaaugcuuaaguccucaugggucuuaaagcacuccucuucagaaugaauuauguacaagccaacauaucacaaauaagaccaagaugcuuagagaguauauuccuuaugguaugauggcuuaccaaucccaccccccacccccguuagucuggggcaauggauccccugguaacaugcccaugggcaggaggaccugagcuuugacccuugacacgcucauaaaagccaggcagcagcagugcuuaucuguaauggcaucgcagaggugcagagcagaggacuccuggggccugcgggccaggcuagccagucaguaaaauccaggugugugagagacccugucuuaaacacaaaguacaaugugauggagggagacauccaguauuggccccuggcuuccacacauacauguacauacacagaaauauacaaaugugcaugcauguacacacacacacacacacacacacacacacacacacacacacacuccucaguacagaucacacauauagagagaaaagaaaucaguauugaguucguucacuucccuuucuccuagggugccucugccucugccucugcauuaauuucacacccacccccccgacccccagacuuugguauuguucagcuuuggcaccaagauauucuuuguaagauguucaguagcaucugugccuuuuguccacuagauggcggcagcucccaccucacacaaugguuacuaacucuccuggcacugucacaccucccuccgguggccauauccuucuuugagaaccacugcucucaaaugagauucuaagcaccuuccuauuccauucugccauuaaguagauuggccaugagcucaguauuccuccaauacuuagaugggacccauuuaccccuccggcucucaggcccgucucccuuaugucugaauuauucgcuugggcuccauucccagaugcggaaugaguggggcuggauaacugagcaggguugguagaaccgcaaaccuaaaccuugaagacaaggaagcuagaagaggcuuugccaagucagacucccugccucucagcuccccccgcccccgccccccccgccccgucagcgcuugggcuucuuucucuguggccuggggggggggcggggggaggagaagcuugcagcccccccucugugcccauaaaguccaucugcaggcaguucacaggaaaaccagucagcacuugcggcugcggaaggcaguccgagaacacuuagggaagcugucgcaaaugccccccaaaaccgugaucaauacauuauuaggaaucacugauagcagaagaagugaauguauuucaaagagaacugcgcucagcuaugcuuggcugccuuguugagggaugcccugguauguugggggacccauguugggggaccccacuguugaacgagggaggcugggagugggaggagguuuugaauggauaacguccccuccugcggaucugcucuuuaagaggaagccucugaaugugugcaagugucauuuuggcggcuggcuccugagccuguauuuacucguacaucugucaccugguucuguaccaucuccagcugccaguuggcauuuccauccaugccgggaugaagccucucucagaggcugugcaggccacacgugcaauauguuaggcuucccccuugaugucuaggggguccagcccugcuggaugucacugugaccuccggaugcgagagccaucaagacuuucccaaacaagggauugauccccagagagcccugauggaguuuuuucaugaaguguuuguugaaauaaagcuuaaagcuguggaagucuaucaauaaagaauucaaaucucuuccgagguggccauuuacacuacacagauacucuaagaacccuugguucuuuacuguguuugcugaauguauguuuuuaaggaguguuuuagcauuaugauauuacguguuauauuuaauuuggggagcaggauaagaaaggagugagguuuaaaaaaaaaauccccacaacagccugcuuauagcuuguugucuccucugcccugucucucuuuuuuuuuccugcacgugauauuugugaaguuggauucacaugugugugcccuuucccccucugcagacagcuugaaaaaguccuucucuggcgugugauuuuucaaaguccugaaugcuuugucuugucagcuucagguuccugagucacucggccccucuuccaccccugggcgcugcaguuaguggcaggcuuuuuuuuuuguuuuuuuuuuuuguuuuuguuuuuuuuguuuuuauuuguugacuuuguaaauauuagaggccuuuuuuuuuugauuaaaaauauucccuauggacuagauaucugacaguggaauaacuagaacaagaacaaaaagaugcuacaauuaaaaaaagggacagugguucucaaccuguggguugcaaccccuuuugggagggucaaaggacccuuucacaggggucaaauaucagauauccuacauauugguuauuuacaucaugauucauaacaguagcaaaauuauaguuauggaguagcaaggaaauaacuuuacaguuggggggguggggcucuccacaacaugaggaacuguaucaaagcguggaggcauuaggaaggcugaggacaucugcuuuaaggggaaaugauuucugaaagucagggcugggguucaguucagccuugacauuuaggggaaggggucugugcccagaugaccugcuuuugggggaacagaacagagugugaccaucaucagggaacaagcugguggucccuggcagggacauuuagaaaacuggcuucccuaauuagccuggguuggguuggaauaugcuuugcucugggcugguaggagaaaggagcaagagguagugagaucuaugggaaacccagcuugguggcuuuccagccaaaggcacacauagcccagcagaaguguuccuucauuggagaaaagccaugacacauugguggcuuugagauucauaaaacaauagagaaauaaacacacugagagccacccgugagguagggaaagggcgcacauguccguucacccagaggcccagaggcccaagcauugagcuggaagcuuuugcaauugagaaugaaucuucuucuacuggggagggaccuaaagacagauuaagacccuccuggugccuaaccagguagaguuuggccaugucagguccaaagagagaggggcggcuaugcuugccuccccagauccaucgauaggacacagauaccaaccaaacaaagccccaagcuguaauggaaaaaaaaaaccaaaaaccaaaaaccaaaaaaccuagcccacacagaggaagaaaggucuaccaugcagcuauagagaggauggcgggcaguggagcuggaagauggaagucagaggcaccuugggagcuagcucguggagcccuggaaaaggaucuggaacuggaaacaaaaaaaaaaaaacaaacaaacaaacaaaaaaaaaccagacucugaccucuuauguaaugaaaaucucugaguucaaggccagccuggucuacagagcuagcuucaggacagucggggauacacagagaaauacugacuugaaauacaaaaugaaacaaaagaaaaugucaauuuaaagaaaggugccgccgggcagugguggcacacaccuuuaaucccagcacuugggaggcagaggcagguggauuucugaguucgaggcuaaccugguuacagagugaguuccaggacagccagggcuacacagagaaauccugucucaaaaaacaaaugagagagagagagagagagagagagagagagagagagagagagagagagagagagagaagaaggagaaggaggaggaggaggaggaggaggaggaggaggaggaggagaaggagaaggagaaggagaaggagaaggagaagagaagagaagagaagagaaaaaggugccuauguuuaaggcagagugcugaaguacuucagaaucuagaauacaauaccauuagagagggagauuguugaagugacaggcugggccacucuucaggcagagggacagucucuauaggcucguucauuugauucagugcaaugaauagaaaauggcugauacacccaaacacgcuugaguguguauaagguaaagucuaguauuggacuuguccucauuagcccuggagacuggaggacagggacaugccagcagcagucacagggaaaugcuguuuucacggggauuguugaaaucacaggacucgagcaugucacagcggggaggaagucaccaccagaaacuuaaccaugaggguaaacagaggaacagaucaggacaggaguuugaguguguagcaagcacuuccaccuaacugggcaacugggcuggacucugaugggggaaagaauccgacagucuaggguuuucaaaaaagccuaagaacaaauuacaaaaggcuggaaguggaugggagaguauuggggaaagcaguaaugcagacguaaaacuaaagauggcuaggugggguggggcacacccggagucccugcuauucaguaggucgaagcaggauugcccaagccuguaaguuugagcucagccuggaccacacguugagauucuaagaaauacaaaauacuauaaggugucaacaauauagaaacgauauaacgauauagaaggcuuaguuuccaaaggacguggcagugaaaagcuugggaaguaaaagcuaauucagauucggauucaggucacagacacgacuuugagccugcugaggugcucagugguaaagauguuguguuugaagcaugaagaaccugaguuuaauccccaggacccgcaggguggacguagggagcggacucugcuaaacucuucucugaccuccacgccugcaccgcggcucagcuccugacccuaagucaauaaagguaaaacggcaaggauauguuuucauaguccgggugagccaguccacacacaaaaaagcccacaguacccugacuucagaagugagccuuugcauucugcaaauggauaccaauggauacaaauggauacaaaucucuuuacuucuuugucuugggaacuuuaugaacuugauugugggucagaaggcaacccuuccugcaccuuuaaacauggcgaccucccugagucauuauuugccuuugauaccauaaguuggacagauguugagaaugcgugguauucgagacuaagagccccaggggcuggagagcuggcucaacaguuaagagcacuggcuacucuugcagaggaccuggguuugcucuccagcacucaugggacagcccauaacugccugacacuccaguuccaggggaauccaugacucuuaugacuuccacgggccucagacaugcacauacaaaauacuuacauacauacaauaaaaauaaaccccgaaagaaaaaauauucuaaauaaguagccaaaauuacuugaaaagacuaguaaaaugcaugucacacuuauacaggcaaaccuuacuuuccacauacuuugcacauguugagaauuuugaaaacggaggcuugggacaacccuguauggagcccuucaugcaggcuuuccuuagcagcaccugauagcuucgagugguccugcgccaucggaaucuauuuugaauuuucagcauaugguagauuauuauagccacuguggagaucugugaccucugaucuugcugugugacugguugggguuacuguaggccacacucuugugagacacugaguugguaaauguguauguucugagcgcucgcucuguggauuggccaguauccuucacgauuccuccucuagcuuccuuaucccgagacacaguuaagagcaccaguuaauaaaauaccccagggacaggaagagucaccugucugucacuuuagaucaaagcuagaauagguucagcccaggaagggauaucaagaacagagacagggcagaagccaggccuuguaaucagucaagccaugaacgccagagaagggcucuugggggccagggggauggugugggugggcaggaaagcuacucuuauaagcacagacagagauaccuuauuucaguauggagaaagcgccaguggucugguuagaggaucaaggcagccacagcacucacaaagucccgacucaccgcaguucgagaaagcuacgaugggaaaaaugacagucagcagggaggcucccagucuuuaaggaaagaauccgguccagagcaucacagcaggagaugaagcagagggugcugaugcaggagaguuagccgagucacuggcugugugaccaaggaugaaggaugcugggcaguacagucucagagcggaugaaauaaucuccacgcgauaguggauucugccacuauagagagacgucaaugcuaagcuucgaaagccuuggguuggggcuaauguagcugguggcuauaugugaagagcuaguuuaccguucuccugcccccccccucccaggauuaucuuaaauccacuuugcacuccgaagccugggugacaguacauccauuuauuacgacaugauuuacugaaacauuugagccccgccauugagaccucaaaagaaaaguucucaucccggguaucgcugugcauugauggugcgcuggucacccaggggccugguggagauggaugguaagauccauguuuucgugccugcagaugucccaugcuuucugcugcccacauaucaagggggcaguuuugacuucugaggccuguuauuuaggaaaugcauuuccuagagcugcgguugccauaguuauucuuuugguggaggucuuucuggagaggauuugcucuucuagaagccauuuaggacaucagugauucuugagaggaaagaaaaaaagcagccuguaauaaauugaugcucauucguguggaaguagcuauauagaugggcuauggugggaagccaagccagaagaccugacucagcaaaacacuacagcagugguucucaaccuuccugaugcuaugacccucgugguguggugaucucccccccccccccaccauagaauuauuuucguugcugcuucauacaguaauuuugcuacugucaugaauuguaauguaaacaucccugucuuucgauggucuuaggcaaccucugugaaaggguuguuugacaucccccccaaaaaaaaggggucacaacucacagguuaagaaacacugugcuacagucaaauaguaacacugcuauggaggaguuguguauggaugaaccaagagagagcaucucuggagaagaugcugccgaggugagacugcagcaagcauaggauuguaguuccugaagcagcggcugggguccaugagagagacuucagcuuuauggaaguuguacaauguaucagaagaaccugcuccucccccaccccgcccuuguagcuacccacagaauguuaacaugagacaacggaaaguaugcaggggucuaugugcaugugagaccaggugcuagaaacaguguuggauccccuggaguggaguuacggguggcucugaguugccggauguggguguuuggaaccuaacucuggucccugugggaucagcaagaacucuguuuuuuuuuuuuuuuuuuuuuuuuuugguuuuucaagacaggguuucucuguguagcccuggcuguccuggaacucacucuguagaccaggcuggccucgaccucagaaauccaccugccucugccucccaagugcugggauuaaaggugugcgccaccacucccagccagcaagaacucuuaaugccugggccauuucuccagcuccugccuugguuuuugggacagcuucucucacuggcauagagcuuauuaauuaggguaagcuggcuggccagugagcccuggggauccaccugucuuugacucccuugacgauauuaaguuuguaucacuugggucaagguuucaggggaucaucuucaugcguacagcccaagcucuuauggaccgagcauuuccccagccuuacucugccuuuuaagucccuuaaugaaugauacuaaguugucugcucucagcaccucuguccucaccuggugccacccucuuccucgugaacacgugccugcauagacacccaugagccaguugaucugaccuagugaugcgcagauucaacucagaaagacacacagugcucuuguguuucaggguuuuauaucaaagccacauuuggaagaccaaggacuguggcagcugcuagcuuuuguguaggcgaugauggaugaugguaaagcagaggccagaggucaacaggagagacuccaaccuuggaaggaaguucuacuauguugcaaaagucaccuuugcuuaaauuaggcccugcccuccaggagcugacccaguugcaaaaccucugcccucgguucuuccaggcacucaugggagacucuaggugugucucccauacgggcuuggaagaggucacucacaagguuguucucuccccccccccccccccccccaggagagugaagaggaacucuauuccuccugucgccaacugcggaggcggcaagaagagcucaacaaccagcucuuccuuuacgacacgcaccagaaccugcgcggagccaaccgugaugcccuggugaaggaguucaauguuaacgagaaucagcugcagcuguaccaggagaagugcaaccggagguagguguacccauaaccccuccaaccccuccacguccccuccaauccccuaaagucuuggagcuucuaggagcgaccuagaggcuuccuaacaccuuaagcaaaugaacuaaccuucaaagaacacugccuaagcuccgcccaccagguguguucucauuggauccuuaaagagccgccauugccaaggaccaagggggaaguggacauuccccaaggcucaggggguaugcuaggagcccagagccuccuccacucagccacaggugaccugcgagguagggugggaguuacccacugaugggacucaaucuccuguauuucaggcugagagagaagagaguaagcaacagcagguucuacuccuagaagccgugugugcgugcgcgcaugcgcacgguguucacgagcgcaucuggguacgggagagccuuauaaacagcccccaggaagagauucaucugugacauucaucguccucucuccgagccacucaccauagagaugacaguucugaagacgcccccgugggcaggaggcguugagaccuuccugcuauuuuuccaccuuggacaacuuucuuaacuuauacuaccccugauagaggauccccccaacugugugccuuuugaacuucccuguucucagccucauugaauaaagacaacaguuucaugccguuaa

SEQ ID NO: 12155 - RNA, 29297 nt, Mus musculus
cggugcgcagacgcggagccgagucccgcugggccgcagccgguggccggcucgccgugggcccguucccggcucuccacgcucgguuccucucgcucugcggagacuggaggacggaccccgcggagcuguggcggcagaauggcgcagaccgccauguccgagacuuacgguaagacgcgcggguuugcguacguguuuagaggggcaggccuuggggucccggaauguugggggccggggucagggucuccagagccggugucuagaauaucgagauauccugcaaaccucgcggugucaggaaccaggcagagauauuuagagucuugggugguuuaggguuggcuugggauccuaguaaugucagcagcugggauccugagaaucuggguguuaggagccagguggagacacugagaauccuaaagugucagcggcugggagggauccugauauucuuggggugucaaggucgagcuggaacuugagaaugucuggguguuucaggcuaggcuggaaucuugaggcucuagggguaucaggcgcuggucuggacucucuggccagcaggugcccccugcugugauucuaccaaguucccucccgcuuugacccugguuucacucuacauuuuccuccuuggauuguuuaaaucucucaggguugcaggagccaauuugucgucgauucuuguccuccucccugcagcaccaaccgcagggaugaaggcucagggccacgccugcguuuugugucucuaggggcaggguugugggccucgggagggugggguggggguguuggaauuccuuucuuugcauugagauuauaaugaguuuuaaguggaugaaugcugucucuuuucuguagaccccuggccucguguauuuucccucccucccucucuccucccguccuccccuccagauaugguugcauuauauuaccuuuauaaauacaaauauaugguccucugaugaccacaggccuuggauauggagacaugauuuuuucaucuuuuuuucuccugcagcacccagccauucucaaugcacgugcugggugcucccccucccccagucgaggcaagaauaaacaaccacuacuauguaugguuggccugugccugccagucccucacgagacuugaaacuuugacguggucugugcucgucguccgaaggagggacucgcacggaaaagcaugacgaucugucagguuaucugcaguuugugccccugcuuccuuccugccacaggguggggccagggucuggccuggaaggcucuacucgguguacgagugccauggaaacuuccccaagaguuugcgguccaacgaggaguggauuuuuaaauucagcugugaccuuaauggauaaacaauuaaaaaccaggcagcagguucugaaggauucagcauggcugugugagaaagagcugaccuagauggguuagagaggggcaaguggacaggcagaccugggauguaggccugggaguguggauugggcauccgggcauccgggcauccaaagggugaggacucaguugaagaacuuuggaguuugagagggugggacgcuggaaagugugucaugaggcacacagcagccugguccacucucuccugguaccagcaaucaucucuuccuguggccaugaagcauaaugccugccccuguaaguuuaagguacucuccagggggugacuggcuuugucagggccacagguggucuacacaugccucugugugguguguguuucuucugcagaaagccacaguaagaaaccccuccagcaaaauacacccuguagcugauugucauccuuuucuuugagucggguaaggagucccagggcgggggaguagaguccucaaagaaagcuucucacucgaggugguggccaagugaggcauggggacagcacaggaagcagcuuuaucccuugguucucucaggcaaugguagauauaagacugcacacacacacacaccuugcuucaccucagauacaguuaauuacgguuugcucaccauagcccuacugauuaaacuuugaucaugaagcugugacuguuaguguccuuucaggggcuggagauaaaacucaguggcagagagcuucucuaagcaggugcaagacaccaggagccacacacaaaaugcgugugucuguuuauucacuuacuuauuuuuauuuuaugugcauugguguuuugcuugcaugugugcucgugagagggugaucuuggagucauagacaguugugagcagcuacaugggugccuggaauugaacccagguccucaggaagagcagucagugcucuuaaccgcugagccaccucugcagcaccuguguauauuuaucucuucccuuauuucaagguauuuuccaaauaugccuuuaguuucuuguuuguauguuuugagacagguucuuuauaguuacagauggcuuagaauucaccauguagcccagguuggccucacacauacccugccucugccaccugaguccuagguuuauagacaugcauccccauuuccaggguuuuuacuuuuuaauuaagucugaaucuaauauuugcuuucagugggggaaccauauguguguauauauauaauauauuaauauauaaugcauuacauauuaauaaguagaagcuuaucuuuagaaagaggcacaaucccuaaggucccuaaggcuaccaccuuaaaagucacccaaaaucaagacaaagacuguuacucucccuugucauuggcuguauuuacaaaguauuguucccccaaauuaaaacaaccagguccgcuccuuccggacauuugccuguuggcuggcggaggaauguuugccuaaccuuuaagcuccuuguguugggaccagguucucuuucuucugugaaagagaggcuuugcgaagcuugguggaaguugaugcaaacuagggggcagugcuucuggcuucugcucacugcugcuaacugcuguagaccggcugcuaccccucgcacuggcugagggaugcccagcaccuucuugacccgaagccccaaacuccaugaucacugcuucagaucacauaguaccauagugcgaauuggaagguucaacagguaggcuucugguuaccuggucuccuugcuucgacugaggcaccuaggguguuaguaaagcauaccuccuggcuugccugugguggguuucuagagggggugugggggggucucuguacaaaucaacagacuaaucgcuugauagacucaugauccgauguuauuauugccaaccugucucuucuuguacgcucuuaguucuaucuguuuccuggccucuauuuccaucuucccugugaaacuaagcaaaacaaauccuccucccuucagcucucuuggucccagcaaacaacgcggacacugaacucaccaccugagcccuccugucuagggaggggguccuccuagcuauuguuagagauacagcgcacuguguucagugagcaccagcagggucaccccaaugcuaaccccauugucagcagccugagacccaagagcuuggaaacugggcuggagagauggcucagcgguuaagagcacugacugcucuuccagagguccugaguucaauucccagcaaccacaugguggcuuacaaccauccauaaugagaucugacacccucuccuggugugucugaaaacagcuacaauguacuuacauauaaugaauaaauauuuuuuuuaaaaaaaaggagcuugaaaacuauccuuaaguuaaacuaaccuuuaccaaacugcugcucacagaaaucgcuaagcagcguauguggugggaaaacgccagggagcuuuuuuuuuuuuuuuuuaaacgucaagugcuagaaaagacuggcauugagggagaauuugagacaagugugaacgcacuaugaucuaugccaugugcugugggaaugucuccugagacagaaguccgcucauguggcuggucccaugguugcuucugucauaguuuauguaugcaacauagacuauuucaccuagaaaaggacacacagcacucugaugucggacaugcaaugcuaagaucaguguuuucugcccauuauucauccuuacucuugugugugugagguuucaauuguguccuuaaagucacacuuaauuccuagcucuggaccuguaugcaaccuuccuuggaaugucuuugggaucuuugggaugucgauugaagguggagucgugcuggaguacuaugucccaaacucagggacucuguccuaaugagaccagggaagccuggccacagacacacccaaggagaguagguugugguaaugagccuuggguuggagagauccagucuccagccaagguacccuagcacagauggcaacuaacuaccaggaagaggacgaggcaggaagcacccuucccugagccugcagaagcuccaucccugccacaccucacgaggccucugguacuuucagacagcaaaugucugccacguuaauccagcugacuuagggcccuuugagaugcaaacccuuggaagcuaacucacaagacauagacaucagaagaugauuccugaagacagguaggcuugauaaggcaauuuggauugacaaggauaucccaaauuaaaauuuguuuucaaaagaccuucauugauaaggcaauauuaauuuucuguuagaagaauuaccuaauugccuuaagucacaacugacaacacauuuaaacaguucaagcagacaccaaaaaaaaaaaaagaacauuuauucgauucaauauuauuuuuauuuauuuuuuugugaguguuugguuuugggcuuuuucaaaacaggguuucucuguguagccccgacuguccuugaacucacuuuguagaccaggguggccuugaacacauuauagauccaccugucuguauguucagagugcugggauuaaaugagugugccaccaugucaaaguuguauuuuucuuuuucacauucacugaaaacuggugaacauuucaaggagcagggcuggggcugaggugggaggaacaccugugaucccagcacuuagaaggcagaaagagaggaaucagaagcuaagggucaucuucugcaaggugcaugugcaugcgugugugugugugugugugugugugugugugugugugugugcgcacgugcaugcgugugugcgcaugcgugugugcgugugugugcgugugugugugugugugugcgcacgugcaugcgugugugcgcacaugugugugugugcauugugugugcaugcgugugugcgugcgcaugcaugcgugcgcgcgcgcguguguguguguguguguguguguguguguguguguguaugaauaugcuacaugugugggugcaucugaucuccuggaccuggcgucacaggcaguugugaacuagguacuggauugaacucugguucucuggacgggcaggaaguguucuuaacuauugagccaucuuuccaacccugaacauuucuucgaaaugagaaaaggcuuauuguuucuggaauuucuucucugaagcucuccgaggggaguggucaaacuugagcuggucuguuuugaucauucucaguaauucuaggagagcacugcccaguuagggugguuuguuggaagccuuuggagggcccgaguccuggccuauugccuuaaccccuguugccaugacagaauuucugagaugggacaauuuugcuuguuuguuuguuuguuacgauuuauuuuuuuuugugugugugugucugaguauuugccuggauguaugcgaauauuccgugugugccuguugcccgcagagcucagacgaucugaggggaucuguuuccgcugauggacugucuucugugcauuugaaggauaugugacauuugcuacuuggugacugcaacugugcaguaaaauauaaaaugacacaagacacauauuacaggguagaacugggugucaugggcauugccaaugaccccaacaccucugaaguagagcuaggaggguaaccugggcuccgugaaacccugucuuuaaaaaagauaaaagaaaaggaaccauguuauauaacaggacauaagggaaggaagcaugguguacuuauagguuggugguugguugguuuuagguuuuuuuuugcucuuuuuuuguuguuguuguuuuguuuuuugcuuuuguuuuuugaagcuugucuacgaguucuaaggagcuggguguguuggcacagccuuuaaucuuagaacucccagggcagaagcaagcagauccagccagaucuacauagagacuccugucuagccagggcuucaaagugagaccuuguuucaaaagcaagaauuccaaagguaguuuauguugugaaagacucggucaauacaaauuggugugugaugauggugaauuugacacguacugcugcgcccaaacaagucccgccuccaacagcaugucacagcacccauuggcugagucuuguggcuguuucuacuuccucugguuuuguuuauuuuuguuguuacuuuguuguuuaaaggcaggguuucauacuggagaaauggcucagugcuuaagaauacuugcugucuuccagauaacccaaguucaauucccagcacccauaucagguagcucacaaccuccugucaguccaguuccaggggcacccaacagaucuggccucuacaggcaccauauucaugucccaccccaccaauacacacgugugcgagcgagcgcgcgcgcgcgcgcgcacacacacacacacacacacacacacacacacguaugauuuaaaaaacaaaaagacaguguuuuauguagcccaggcaggccucaaacugcuuuguagcccaggcuagucuugauccugauccuccugacuccaccuccugaaacauaugacaagauugagccaccauaccuggccccaucuucucacagguacaagugugcuuuggcuuuuuagccuuauggagucagugauauuuagauggaaaaaagggacacuauucauaaagugcucauaaauuaugaaugggaggucuauuuuagagagauguuuaucauuuucuuuuccaacauaaauuuuuaaucaugcagaaaagcgaguggagguuuaaaaacaaagcauuuugucauagcuggcucuguacguagagugugcauuuagcagccccccuggcuucuggugugccugcuauagugguuugcuggaugcugagaaagaaaacgcaagucugagcgcaguccauggguccucugcucucgcucaggaucaaagucaaaccuucuuucaauauuagaaaguaaacucucgucuuugggaacagaggguccaggugaccugucuccguccucugugcaauccauggacagccagccaaaacaggcuuugaugugaauccauuugagaaacaaugcuuuugcucucagagaagaugaaacaaaaaaagccaaaaauaaauagacacuugacguggaggccugguuuuauuauuguguuugugacagaaaucagacagucccauuguggugguggaaacggaacuaauaaaaccuguccuguagaucgaguuuccuggacuggggagaucacgugggcaccucauguagccugaaaauaggcaaaacaagucucccugccgaggacacaggucuggagccaagggcccugccaagccuuagagcagagcgugagaggaccugguucugcagccgccagcuucuggggugcuccuggagagacugugagagucagaugggggcgggguggccgaagaaguaacagggugacaagccaggccuuggguacugauccaggggcugcggggcacauuugugcucaggaugcagcucagaaccccaguggagaacaccagugcagucagucgcuggcuucauuguuacuguuugcaggaugacuccccuuugucccagcucaugacaaccugguagccucucauucaccccggucuccaacgcccuguguaggcaggggugaccuucaacuucugaggcuccugucccuacccucugaaugcaagauuauaggugugcaccaccccgcccaguuuauggauacuaguuaucaaacccaguguguuguguagguaaggcaggcuugcuacagucauaaaacauuacaaauguucugguccauucuucaggaacaguuccugcuccuuaguuaagagugcucauggacagacuguuucuaguuguugccaggccucagcuuucaggucuggucgaaacccuucugacaugaaugaugguccucugaccacugcuacacugaggacuuucccaaccugagaagcagguaugugccuuagucaucuuaucuguggaugggagugaagccauauacuucuugcccaguguacugauacccagaacucagacccacuaugagauaugccuagaucccacaugcagcuggaugaccaagaggcuagccuucaucaccccuacugaugugaccagauuuugucgacuaacggugagccauauggauccaaggcuaacuaugcucaauggugggagugcacagugguaccucagacccauuaggccucuagagcauggacacggucccucuguccaguauacuguuuggaggacacaugcuuucugugugagccugugguggccugaucauagaacucaucacaauaggaggucagacuuuucaaagacgaugagaccucaagucccugcccucagugggucaaagcugacaccccaggagccagcuccccguaaaggaagagcugagagccagcugacuguucucuguguggcaugugucaaggcaccucaggccagcccauugacucagccuccagucaagcuagcuguucacacugggugggguaacccacaccuguaaucacaauacuugggaggcagacgcagaaccccaggcuacauaguaagacccugucugaaaaggaaaagcuauucagcucucucccucuuucucuccucucugucucucuuuuuaagugaacuauucugaaaaucaucuugacagauuauuugcccuuguuucuuuauagaguuugccagguuucauccuuccguuaaccuaaucaacuucaacagucuacucuuuuuuuuuuuuuuuuuauuuauuuauuauauguaaguacacuguagcugucuucagacacuccagaagagggagucagaucucguuauggaugguugugagccaccaugugguugcugggauuugaacuucggaccuucgggaagagcagucgggugcucuuacccacugagccaucucaccagccccaacagucuacucuuuaauacacuuaagauuuguuccugacugagggcguccauccgaauugggcgucguuaucuuuagcucacuguguccugcacuggcgcugaccucucuccuuuugggcugccuuucccucaggagggcagcagacgcugcauuuuccugaaauacgcgugcccuucaugccgagcccugccagcucuuuagguuguugcuguccgcagacauuugggcuagccgucaucagagucaucugcuggcuaucuuaucuugcuuuguccucagcuccugacugaccuggugacugaugcaucuguacagaggacuggccaguaccucagccucacagcugugugggaucauuucuggccaccuucucuucuccugcuucagguguucauuucccuggcuuuacucugggugcuuucugcccccuucccaucccugacugcauccauccugaggucagaguuccuggcucuucaauaagccgugguccauacccuucccagauaccccgcccuucacucccagguccagagucugcauuugcugccacugugucucuguguugcuagaagaugugcuuugcaacauccuggcccagucuucuaccagaucugcugcucuaaggcugcaagcuuuguaggggcugguggucaggauucugccccaccucaagggcacagacuucaccagggggccuuucauggucagccugugagggaggcuacuguggccucaaccuuguuggcucacaggauuuuccagcuggaucugccacucaguaucucaaaauagacucuccuugcauccuuugacaucccuuccauuggucuucacaucucaaacucuaagcaugaaagcaaggaagcccuagaucuuccauccugccuacccaaagccaagcaccuguucgaccagaagagggacccuggagggugcacaauucaagggccuccaucccucuauggccugcggaaaucucaacuucaaaguggcaaccugaagggaacacuaagcaggcauuguagaacuuguguucaaagcucucuacugugaggcuggguguccuggaagggggccaccauguuugugucuccuuacugcuuucuccuuccuuggaggaagugggcagcauuccugggaggaucaggucauugucuccugaagucuagugcuggcagagugcagguggugaauacacgcucucucucucucucucucucucucccccucucccucacucucucucucucucucacacacacacacacacacacuugcaugcacgcacacuugcacauuguggcacucccucaucuuggggguuggacauccaguuucugaucaguuuuaucuuagcaucgaguuccacuacgagcucagaaaaagaaaauaacaggaucccaagauacagaguggggccaugaucugagucugagaacaggaccagaguuaaagcaaaauggggucacagcgggcagagcugcacaagcagaggcacuguugaccaagcaagccugaggucgugggcgcuggcugccgagcacagugugcaacgccaauccgucauuucuacucggccccgacugcagaccguuccgugccuugguucaugguccugcugugggucugcugaggucuggggaggagauggggcacugaguaucauguccucuggcugcugugacuuuuucugcuccguggaaggguggcugugucuacgcauggcugcugauugcuugguagcuuucccaucauccaucugacauuuaucauauggaaaguuaaaagcacgcuuagcacaaggccccauuuuagcauuccuauuuugggauacagacucuucccugccuucgagcuaauuccucccugaagaaaccagcauuaccugugaguguaagagccgugggauuuuucaagaggauccuggaaggaaauaccccgagaauggaaauuuaucccaccaugacaugauuugggaggggacagagcucucucucucugucucucucucucucucucucucacucgcucucucuucucuccagccauguaauaaauauucauaaacuauaaaauucuucaucucagaaccccugugcuguuccuuccacaaccccuugccacauuagcaaacauaccccucugcucucugccuccuuucuguugauuggccgguaggugggugggugggugggugggugggugggggaagguuguuucauguauuguuguuguugguagggucucacagaucccugguuagcuucuaaagccuuaaauagcugaagcgaccuuaaauuccugauuuugcugcauccaccucugagugcugauggcugucccaucccguucucuuuacagcuucuuggugauugcucgggcacagcaucgugguacucggugucacugucauacgcuguguagugucauugucagauguacagcgucauccgaugcacgguguuauuauuuuacuagauaagugaacgguagaccccuuccuugcuuuccuguguaucugccuaccuuccccugcucuuaaugucccuugccuguggauucagcuguguggcacaugugugcagugccuuuggaggccagaagagggcaucggauuccccagaagguuguuaccggccuuaggaguuccaggaacugaacacugguccucugcagaaggagcaaguguucuuaacccucagccgucucuccaggcaccauuuuguaucuccugaacauccccacuucucacuaagucaccugaacguccccgcuucucauuaagucauucuaguaggauuucuacaaucacaucaggaagaguugcccuuuuccuuucuuuuuuuuaaagauuuauuuauuuuauguauaugaguacacuguagcugaacagaugguugugagccuucauaugguuguugggaaucaaauuuuuaggaccucugcucauuccgguuaauccccugcuugcucuugucagcccaaagauuuauuuauuauuauacauaaguacacuguaguugucuucagacacaucagaagagggcaugagaucucauuucaggugguugugagccaccaugugguugcugggaauugaacucagaaccucuggaagaacagucagugcucuuaaccacugagccgucucucuagcccacgaguugccauuuuccuaaagccuccauguguaguuuagagcccagaagaaggaaggccuguuguacuugcucauaacuauguuaucagacuccaaaaacuugugacuuuugaaggaagagggacacugggguaaguagcugcugcagccauggcucugcccucgcagcuaggaucuccccaugucccugagggagucuuccuuccugcugaccgcaccacacccucuguccaccuuguacucggguaugcaugcagcaacuccccuccaugguucaagguuauguucauccugacaauuucuuugguuguugcugcuguuuaucaucacuguguguauaugcauguauauguguauaugcauguauaugcauggggggagggcauauaacguguuuccguauuugcaccuuuaccuggacuccgaggauuagacuugggccaucaggcuuagacaggaagcaccuuucucugcugagccaccuuguuuugaagcagggucuuacacuguagcccaggcuagccuuggacucuuagugacccucuugccucugccucccaaguacugagagcccaguugugaauuaucauacucagcugauuccuuuaacguuaguguucuaaagaccucagucacugugccuuuugguguuaacuuucucucacagauguuugguuucccuuuguccaccucaccuuucaggguccccuuguguguuuguuuuguugguggugguuuggugugaugagggugugugugugugugugugugugugugugugugucucgcuuuguugccugcugguaaguuuccuacaguuuccacuccacucauucucccuucccugucaucuguuccucgaucugccuugaguacugauuuuauuguuguuuuuccaggccccuguacauggcaggcaugugcuaccaccuaguccacgauacaugcccagcccucuucucucaguuuuuaauuaugaaacaaaguuguccaggcuggauuugaacuugugauucucuugccucauccucucaaguagcugggugaaaagccuggagcaccaggcucugagagaacuuauguucagugguuaucauuuuucuucccaggccaucuagacuauucgacccguucucucaagccuccuguuccuucauuuuucacugugucuucauguuauuugccauccugauggccccuuaccaggcugcucuuuggcagggccugaaggcggggucugcacaacagugaggcacugagguacauccccaccccagugucccuguucucugugugugaacgccaagaacuucacacaaacgggaucauuguuuggcuuaugucucuuaucauaauguccucaggaggaguuuuguaguuuuugguugcaaacuuaucucagagggcugugugugugucggggugggggaaccucugcgucucuaguaaaggugucguccuuccgaagcagucugcauugcuuucgggguuuuuauuguugacuuccugacucaggcuuuacuaucuagaguaauuacaguauuggcucauaauucauuuuccaaggggacaguucccauccuccugagaggagcgaguggguuucccaguugucuggguacuccagaccccagccccaccccaggcugcaccugcacuguuccagcaaggcaccguuacuccuggcuuccuaaacacucuuaccauucuuggauauuuggccaaagugauuucagacaaaaugcuuucuguuuauaaucucuuagcuuucugagcuuccguguucuugcauugagaucauguaucuuucccguccuuucuccaucacggcacacuaaugugucccccucuggcccggcguggcaaugguacagucugguacagacgguaguuuauggaggauaguucagcaaaucugaaccaaaguccaugcucagcuacgugaguccaagguccagagucggggauugugugcuggagucuucagugucacaguaacucugccugaaugucgccagccucugugccuucucccaccacacucaaggcaacaagacacccaacauuugauucuuuuuuuuuuuuaauguucucuuuacaucuuauauaacuuuauuuccuaagagaggagaaugcugaacaaagacgaggcaucccaguucccuuagccuggcgaucguaaccaccucaucuucaguuucuuggggugaaaaugcuguuuggugagaaugauuaggcuugguuuuccuuguuuuguuuuuuuccccuguggauaggaauacacacacucucuccuuccucucuuucucucucucccuccucuccaccccugccuccaggagaacccaagugcgauuccuccaagcucacguaaaagcugaguguaguaguguaacacacgucuggauccugguguuccuacauggagaugggaggugaagauaggagggagaaucacuaguucucaagccagcuggccugacacaugcugcguuagauaaaaaccaacccugucucaaacaaaauaaaaugcaagagccagcacccaagacuguccuuugaccuccacaaugugugucauggcacaaguauaucugcauucguacguacacaucacauauuucauauguauacuauaaagacugaaauuuuguauauacauuucagugguguuaaaguacacucacacuucuuaauacagaggugaccaccgcacaucucuagaacucucauguuuccaaacugaugcucaugccaugaaaugaaguucucauuucuaucccagccaggcccuggaaacccucacuccacuuuccaucuacuguaagggccucacguaaauagaaucaucaguauuugucauuguaugacugguuuaugucacuuauguccuaaaggucaucugguauagcaaguuagaaacauguuccuucuuaaggcaaaguuccauuccauuguauggacacauuucauagacucaucauauggacacacugcaugaacacauuguauagacacaccauguggacacauuguauagauacacuaagcuuaguuauuuucaucuuauaugugugucuugccuguguauauguaagugcacacugucuguacaccugaugccucggaggccagaugaggaugcuggaucccuuggaacuggaguuacggaugguuguaaacugccaugugcaugcuggaaaacaaaccuugguccucugcaaacacagccagugcucuuaaccaauaagucacuucuccagcccuuacuauaacuuguuuuugaagcagaauuaaagucuguuaaaagauacuuuaauauacauuuuauacauaauuauuaagagaaaagcacucggguagaaagaagagcgaaaucuccaugucaugcuuuaaaaacauauggugagaggcuaaaauuguucuaaugaacuaucccaugguuuucugcaaccauuuggacaucauuggagaccaaauagacguaaucucugagugaugguuauaguucuagaaacugguggcagggccaugucaaaaacuagcagcugucucagcugaaugcaggagagcaggcauggcuagggucaucaguacguggucccauuuggaagaggaugugcucuggagagaggaauacagagcaguucugggcagggaggggcuugcagcagauuaggguuacuucuggaacaaggauccaaugaugugcagcucccagccaugcagaacuagaguucuuacuaaagagauagcaauuguuuggacaaggugguaagugccuuuaaucccaggucucaugugaacaggcagauaucugaguugaagccaaccugcucuacagagcaagguccaggccagcuagaacgauauagcaagauucuguaucaaaaacagaccacaagcuaccuaacacgucuuuaaucucagcacuugggagguagaggcaggcagaucauugggaauuugaggccagccuggucuacaucgugagguccugucuuagaguaggggauggaugaauagagagagggagggagggagggagggaggggggagggaggaguugaagugcuggggauguuggcacacuuauaaugguguacuuaggagacagaggcaggagaaucaagaguucaaggccagccucugcuacaaugaaaguuuucaacccugacuuucugaaacuauguaauuaacaaauuccaucuuggaaaucuuuuauuccaguccuguaaaaagaauaccccaggggcuggagagaugacuuagcaguuaagaacacugguugcucuucagggguccugaguucaauucccagcaaccacaugguggcucacaaccaucuguaauggggaucugaugcccucuuccggugugucugaagacagcaacaguguacucacauauauauauauaauaaaaaaauaaaucucaggagcuggagauguaucugagcagugguucuuacccugugggucucugucccucuggggguccauugacucuuucacagggucacaucaaauauuuauauuacuuuucauaacaguagcaaaaucacaguuauaaaguagcaaugaaaauaauuuuaugguuggggguccccauaacaggaggaaccgcacuauaggacugcagcauuaggaaggcugagaaccacugucucagagcguaagagcauuggcugcucucgcugaggacugggguuugauuuccagcuucuacacagcagcucacaaccaucuguaacgccagcuccagagggaucuggugcccucuucugacuucugcagguacugcacacacguggugcacagacauuuaggcagaccacuaaaugacccugucuguauugaguagugggcaugcagccugaacuugaccucagcugcuuuccaggaaccacagccaagggaugaagugacacucagccacgcguccgagaacucacacguaaacguguagagagggaagaagcaggcuuccaucucuaggcugauuaugcuugcagcugagaaugcguguucguaguggcuagcagggaccaguuuuauucauugucacaguuaauuuuuaaacaucacauucaugaagaaguuaucaaaggaacuguuugaaggagcucugagcuuaucagaagcacagggacgugaaaccgguaaauaaggaaaggcaacgggcgucuccacagaagacucaguuaccucuuuuaucauaucagcaacugccacuucaccauaguuuacgaaugcauucguggcucccuuuaaaguuauuucuuaucuuuucuuugccuuucagauuucuuguuuaaauucuuggucaucggaaaugcgggaacuggcaaaucuugcuugcuucaucaguucauugaaaagaaaugugaguaacaccaggcaucuuaacagcacaugugaaccacccgcaugcacgugcuucugggagagcugggcucgcuggcacacagcacggacuugcucacgggaaagcagaacuuuccgaggggaaauuccuuuuuaaauguaugugcauugguguaucgccugcauguuugucugcgugagggcaucagguccccuggaacuggaguuacagagaguugugagcugccccgugguugcugggaauuguaccaggauccucuaggagagcagccagugcccuugaccucugagccaucucucuggccccaagacuucccucuuaaaaauuuauuauuugaaaauuucauacauguauauuuugaucaucuccucccccauuuccuuaucucuuccccucccucuaggacccucuuccuaacauacccccacccucuagaaccucccccugggacccucuucaaaguaaccccccagcaccccaauaucacggacuuauuuguguagucacuuauuaaggucacuugcauauuuguguggggucauuuacaggaucauggcacaggcagcuuaccaguggcuacaccccugaaucuaaacaacucucccucccuuagcugccauuaacugcuaaugucuccucagccggugcagccuugccuaaugagccccucacccuucuaggcuggaaugcugaugggcucgauuuugugcaggcuuuacacaggccacauggcaccggugcugugagcucgugagugcaguggccacaucauguccagacauguguaguucauagcgcuccuccccgccccauggcucuuauaucuuuccccugcccucauucccccaucccaacacuucucugugagcgacccucagcucuuauucucagcacuuugagcagcugugagucugcguuaaaaggaagguucucugaccaagguugugagcagcccuaaccucagaguauacauguaaacaguuagaaggcucuuuaacaacacguccauuuagcaacacaacuauaguaaguuccccaacuaagcccucuaaacuguucagcaugggcucuugaccaggauugcagaaccauuaugaauuuucuccuuugaggcaggccucagauccagucugagugguugguuccuccuguaacagucacguuacuguuguaccaguggcacauccuaccggguggucagcauuguagcagcagggucuacugccggguaagaggacuuuuaagcagcacuacgagguugugguuuuuuguuuuguuuuuaaauacaaggucacauuauguagccuuggcuagccugaaacuugcugcauaaaccugaauggcccugaacucagaauggccauucacccagugccucugccuucugagugcugggauuaaaggauuuggcaccauguccauauagguuguauucuuaaaccuuuacaugauggcguuuuuauuaaguuaguguuucgguucaauggcagcuugguguauacuguuuucucacccuuacccuaagauggugagcccagcaaaggauucuucaauaggacucuguuugcugguagaguagccagauagacaucagagugcaguuggguggguuguagccuucaguugcccugggugccuccagugccucugaggcccuuugucccuauccuguccugcucugcgggccaggaagaagaauggaaaugacccagcuagcgggggaugucuguuacagaggacgcuggaccacagugccacgugcuuaccucggcucacagcauuuagggaagggagauccgaucuuucuuccacacuguuuuaagacuguggaagccuguaaguucgaaaacccuuagaaaacgugaaacuguggucauggugugaggaacuguggagaccugcucauuagggcagucagaggcaggcucaacacagaccuggcuuaauaaauuacaucuaaggaggggaaccccucagguugggggagggagagagacagagcaucuuggcaaagaaugaaagacauuucuggaauuucuuccaucaggacccaucagugcugagcuggucagauccucugcccugcaugugcuguagcauggcuuaccaacagcauccucugaaccuucacuuauuuuugauuuuuggaaaugguucaccucucauccuuuagcucucuggcugcccaggaacuucguacacagccaagguggcaucgaacucacgccucggccuugccucagcccccccagcugcugggauugcaggcaugaaccagcagauggcacccuucccgugugcacagugccugcucgugguccuuucaggcuuguuagcacacugcacugcuccaucucugagaauaguuaacagccagacagguugcauauccguuccugccuguccccagagccucagaagcagcacacucaccuuauucagucacagcagccuccgccccauuacugcucaccuuacuuauuacucaccuuagucggccuggauuacugcuuaggccucccucugcaguuugcugggggggccggaggggguccuuccuaccugaucacacacuugaaucuuucuggcgcaggcuggauuaucugucuaaccucuuguccauccaaauauucuuuuuuuaaaaaagcauuaccaugcagcaccccugguugcugaagcuguguccaggcaugagcugagcugagagacagccagugaggugcagcguucucucgaagucauggcuuccucacagcuauccuguacugauggcaugccccagaugaguuuagaagagauaggacugguuucuccaauaaacccacggaaacauuugcugugcucugcuagaacuaauggacacuugguaauacacauaggaaagaaccaaauggggaaaaaaaaaaagauuuguccagacagaccccaaucagagugcuauggucagguuaucuuuggggucuccucugcuccagaauaacacuugaccaccuugcugcugaucaagugcccagcuaguuaccaggcacaugcccuaccacauggcagaccgguucccaucagguuucuggcugcuggugcaagucuucucggcagacagucugggaucucaagcucagggcagccucuuccaguagccauaccauguguuaggagacagaggaacucuauugucucggugaaaacagaaaucgugucauaugcuuaguacggcccaucagcugacuauuagagaaugggcgguugaagcaacccgccuuuucaccugccaggccccugccuccccucccccaaacaccucccuuuuuacuguuuuuuuaaauuaguuuuccagcccuuggucuaucuuaacguugcuguuuaaaccuugaacuguugcagucagguucuaaaguguaauuauuuguucuuuguuuuucuuuuuagucaaagaugacucaaaucauaccauaggaguggaauuuggcucaaagauaauaaaugucggugguaaauauguaaaguuacagauaugggacacggccggccaggagcgguucagguagcuuuccuucuuauuuacugauaaugguacuuggaaggcuuagcccaacuccuucacugcguguggucucaaaccagcaugcacacguaacucaaaaucugcagcuccauccggacgcucucacgucugagggcccugacuggaucccagauaccaaaacaaacaaaccaucacuaggggacuagacucucagagguagcaacucggucaggaggaugcgguacuggcacuggguauccguguaguuggcuuuugguuucagucuguuuggcauuuugagccagcaucucgcugugcagucuagguagaccucaugcccacgaccuucuuguaucaagcucuguaugccaggaugaccggugcgaagcaccauccgggcuauaguaugccuucagauuaaaaucaaggcaaagacaaggcagguggcuuuuucccauauuacacgucuaugagggauuuuuaaacugccauggaggguuuuaucccuuuacacugacuggagcaggcugugacaguugccauggauccugcaggacagguucacacaacuggcacucagaaagacuuaaccccagaccacugcuaaucagguuguguggucagcauccuguaacaaugaaugcacaguggggugugaacauuuuagccacgcauucugcagaguacaccaagucacagagucaagauucaguguggaagaagcgauaacccccacccacccacccucccacacacgcaggcuuuucacuuuuuaauuaaacuuggggauagaguaugguaguacccauaguccuagcuacuuuggagguugaggcaggaggaucgcucuaguccaggggaucaaggccagccugggcaauagagugugagaccacaggugaugccagagcaaauguuauucugcuaguauaaaaacuuaacaagauggcucagcagcuaaaggcugggcaagcgugacaggcugaauuccaucucccgacuaugcaaagguggaaguacagagaugacuccacaaaguuaucugacucccacauacaugacguggcacccaccugcgccaccccaacaucauacacacaaucaaguguaaaaaacuagcagggagagagcaguugguuuuacaggggagaaaauacuaaaaaccaguuccuugagaaugugagguggacagagacccaguccucaguagagcaaggagagaagaaggauguuguguaggucgaaguaaauguggccccuggcagggaucuaggcuguuccugucuugggcuuuaccugggaagaagggagggaacagcauagggcaccugggggugggggaggggacagagaugugagggucuccuggugccugcugcccacagagagcucaggacauucgggccacaugcagacccaugaaccucgugaccuaaagagcugcucagcagagcucucccuguuuuggagagagcgcccugcguguccuggcucuaugugguucaaaaggaagcaugguuucuauggggagaaguaaagggccuugauuguuagaagccccugucauuccuucaggucugugacgagaagcuacuacagaggugcagcuggggcacuccuugucuaugacaucaccagguaaugucaccuccccgucgcucaggcuacuugguguucugcaucccuguguuggcgagacauaugauuuaguucggucuagauaggcagcauggcuguacccagggggaucauaaaggucuuugguaugugugaggugcugggacugaaacaagccuuuggccucauccuucacacugucugagacacgcuccucaaggucuacaaggcugugugccuucucagacauaaucaagagguugaagauacagacucaggcucaaaucagugggcucagagccuagcuccaaugacuuuucaaacucuacaggccuggacuucauaaggguaaaauucuugggucguagaggugguuaaaucaacuaaugaaauacuguugcaguuguaguuacuggcuacauguaacaacuuaguuuuauuccuggguugcucuggccacauuucaaauguuccaugccccacaugccuggugaccacaggacuggccagugcagcucccagcacacucccgucuugaaaaucucaucaauccacugaccucagaguuagcagcauuguccuggaaacacgugauccaaaagguuccaccaaggggcccuuccugggaggaaccugaccuaggagagaacaacauggcugccuuccucuucugagagggggugacacuccugacuucacccuccucauuccccccggugccaugagagacucaaccugccagggugugacaucacuuguguggguccuuaaaugugggagccaaccugcagaucugagcugguccuggguagacaaaagccaggaaguccugcauagugucccuaagccccaggagguccuugcaaaguugucgugguggauuccuaugggucaaggugcucacaagucuacaggugaccaugauuaguguugcaagccaggcacguaucuugcacauacucgggguucaggugcaucugugaagggaaggaaagcccuuuuuugaaacccagaggguuucauuguaauagaagcuaaacauagcccaugagccuauuguaucaccaagcauucggguucccacgucaccucugaggcccaguugauaaacagugugugcauggugaggaugacuggaaacaguugcuaguuuuauaaaauacauguaucauuuccacaaucuuaugucacacagccgagaaaccuacaaugcgcuuacuaauugguuaacagaugccagaaugcuggcgagccagaacaucguccuuauccucugcgggaacaagaaggacuuggaugccgaccgggaagucaccuuccucgaagccuccagguucgcacaagagaauggcaagugacuuuuuccucuaagagagucucucaggguggucugggcacagugacauuugggggucuuaaccaccugguggaguuuugagacgaagcuaucuuaugaaacuguggagucucuacugucaacuuaggcuauuucagcauagcuuagucugugcccguugugccgacaaaggucaguggguugaggaaagcaagggauuuaccaucugcagggcuuuuaugucucugguauguuagccaucuuagaguggcacguuuuuuaauguaaccugaagcauaauugguaaagucauccuccugcauagaaaggaagcagaugaaacagccagcuagcuucauuuucuuacauuaagucauucauucaacggcagcaaaccucuaccuuguuuauucuuuugagacagagucuuuuuauguagcccuggcuguccugaagcucacucuguagaccaggcuggguaacaacuuuauuaaugucaaaaccgcauugcaaaauuggcaguugcuugcagagauaacagcauuauaaacauuuaggaagagccuuaauucugagccagcugagacuacuccauccuuaaguccacauaugguuggaggcagacagaaaccugcuuucccaucuuaacagggguuuacuaagaacuaaacaugacccaggcuugguguuuugggcuugcaauccuuguacuuaggaggcagaggcaggaggauuucugaaaucuugaagguagccagggcuauacaaugaaacuguuucaaauggggggaggggaaauagaggaagaaagguaggaagaaagaaagaaaaaggaaagagaaccaauuaagucuacacaugagauguguggucccaaccuuccuaaugcugacccuguaauacacgacaguuucucaugcuguggugacccgaccagaaaguuauuuucguugcuauuucacaacuguaauuuugcuacuguuaugacccuuaggcaaccccuaaccccuagggucaggacccacagguugagaaccauuguuuuaggauuagcuguuuguaugguucucuguauagcccuggcuguccuggaacucacucucuagaccaggcuggucuugaacucacagacauccaccugccuccugagugcugggauuaaagguguguaccgucauccaaccuccacccugccuccccugcucccccaucccuggcauuuuagagcuauuuagaaagcaggagguguuuagaaugaucaggaaaacccuccauuaguacagaccuguuaguacaggcuuauagcugugauguaccugccagcaggcuuuccccugcuuuccccugcucuggagauaaaggaacaugagucuaaguaauacagcagggcuagagagccggaucagugggugagagcacuuguucuuacaaaggacucaaguucgauucucaacuuaaccaccacguugggcaccagguauccauguggugcuuaaacauccauucaggcaaaacauucaugaaaaacuaauaaaaauaaaucaagugggacuacaaaaccuccccaauuauuauuaaugaucauuaguauuaacgauuagaggagagccaaauuaguaaaaauuaucuaggaugcccaaauguacacauuuuuaaacugaauauaaauuagaagcugugggcggggauggcuuuucuuggacaguggggcuguggcuggcugggauggacauggguccugcucaugugcuguguagugcagugauuugucagcacguagaucacuuggagaagaaaguuuggcuccaagucaugauuuuagccaaacagccccaacuggcguaguaacugccacagugugcugccuucauccugucagcucgggggucagggcacaacaauggcuauucuucagaaaggguugggcucccauaacugagcacaucaacacacccggaccaauacccugugaucccagcacuugggaggcauggucaagagagccaaaaguuuaagaccaaccucagcuacauguaaccuuaucucauaaaaacagacaacaaaaauauauauuuauguguauuaauuuuacauuuacagaaagagaagguuuagguacuggauuuugcauguuucuacaugagaauccugaacaggcuugucagcacuuaaaagucacugucauugggccagcaagauggcuuagaggacaaagacacuugccuccaagcccgaggacaucaauuucaucccuguggcccacauagcggaaggaagaaaagucugaccuacaaacuguccucugaccacugcgcccacaccauagcaugcacucccuccuagaaugagaaucugcacugagauuuuaaagaucacucucucucacucugcuaaauguggcucccucucuucuuugauaccauuuguagagcugauguuccuggaaaccagugcacugacuggcgagaacgucgaagaggcuuucaugcagugugcaaggaaaauacuuaacaaaauugaaucagguaccagccuuucccuggccucaucuguggguuuugcccuguagcucaccagugcccccugcuggcugugaugagcaaggcuguaguaaagcucugcuauauagcaagucagucaugcuuaccugagagaagcaagcucccaggagucccuggucaggggcaggugugcgcugggugcuaucaacuugaguuguuacacacuaguaagugaacauugcuauugcuguugcuuaguuuuaaguucauuuuuuuaugcauaauacuguuacaugauuccacucaaacaucgaaaacucaggcucagaaagcacacauuuuucgugcggaggauccaaauuccguuccguuccuagcaccuauacuggauagcucauaaccgucucuaauuccaagagauccaaugaaugcccucucguggccaucuugggcuccugcacacaggugugcauacacacauuuuaaauaaaucuugaaaacuccagaagccccugaagucacuaggaauguuucaugcccuguacuugaaugaauacuucauucuuguaggcacuggggugauagcauauaaaugugaggaccugaguuugaucccuagcacccguguaauaaucugggugugauaguacaugcuaguaaucgaggcacugguaaggcagagucaggaagaccccugaggcucacucgccaggcuguguugccaaguuauugaaccccaggucucagagaacccaugucucaaaacagguagaaagcaugcauguugagcucuggcauccauguguuacacaccuacacacguguuacacaccugugcacauguguuacacacauuuuaaaacuaaggcauuucuuuuccagcccagugugguggcgcacaccuuuggucccagcauuagggaggcagagacagauaaaucucuauacucaaggccagucuggcccacauaguaagccaaagcuaaauagugagucccuguuucaaaaaacaaaaaauauuguuaguagauauauuuuugcucuccacaaugaagacacaaaugcaugggacaucacacuuugcccuuuacuuaccguguguggggaacacagagucacaggcauuuuccugguccucaggugaacuggaccccgagaggaugggcucuggcauccaguauggagacgcugcccugagacagcugcggucaccucggcguacacaggcuccaagugcacaggaguguggcugcuaggcgccccagugacacagguggauguugggggcccugcauccuggcaggaaggaggggcuguaaaacugcaguaggaggugaagaggaggggaggagaggcccuuaggaauagucagaggucauccccacaggacuggcccugcaggagcuccucccccaaccauucagaagcaaagaccgggcugacagggagagcccaguggucgugcuguagccauucuucacucaaaccacggagugcacucgaccuaaccggagcaucuccagaacuagcaagcucuccgcuaaacuuucaguagcgcccucucccauuuaccauaguggacauuuuuguuggggaaguugaggcaggaacucacucuccagcccaccugggccccuaccuuaggacaauccuccugccucagccucccucccaagcccugggauuccagguccccaugcccagcucacaggcuggcgagcagugugagccaguguugaugcagucaggucugccgggcucugagccguuuggucuuuacaagcacaggaguaucugaaucacgcuuaacgguucucagguucagcgguggguccuggaguacagccgccggagccugaagaggcuggaguuuuuacuaccaucuuuucuacucggcacagaaguagaucuuccuggggaacgguguacgcuggcagccggggcucagcagccauucugcgaacuaacucagcggacaguaccuuuagaugccacauguaugcagaccccugccccacacguacccuucacguucuguuaaauccagcuugugcugcccacagcacguucccacagcacagagccggugugacaugacagaacccugcacucagugagcuuucuuuuuaaacucccaggaaaugcaguugugaaugugagagagcgugcuuuucucauugcgcguugguuaacucccaggagaugcagucaugaacgugagcgugcuuuccuccuuguguugguuaugcguaugacccgguaugaaaggacucuggugugaacagccagugcguuucuuauuuaaucccucuccccccaccccuuuuacacuguuucugugauccacaccugaaaugcuaaacccacaggacucauuaacaccuggaaauaaaguggaacggaguuucucacgcaca

SEQ ID NO: 12156 - RNA, 47418 nt, Mus musculus
ccgcggagcggccgaggcccgccgacgccacccgagaccaaccgagaagccgaggcccgccgacgccggcccgagacccuccgaaaggccgagguccgccgacaccgacccgagacccuccgagaggcggaacgcggcggagcccgggccgcccgcgugucgggcggacgcugcgaaaagguaaggccgcgggcguguggacgugcgggcgugggcuccgggcaacucgggcuaaccaggcgugucucugcggccugggccggguggaguccgguuuuagggaccgcggcgcucggccucguucggcugcagcuccccgccccgcccggccuuguccuaagggagggucgcgagcccagucugucacaccggggcguggcgggguucaaggguggguacgacagggaucugggugccgcugaccuuagagggguucgguccgucggugcccagcgggcgccuuuccccagcgcggcgcgggacccugggaaccaggccgcagcgcccgugguccgcgaggcggugcccacccggggccucguggaguguggcugccuacccuuucucgugccuccuagugacaggcuggguuaaugaccgcgcugaucccgaaugccacagugaauuugaacuuuuaauuugaaaccuaguaauaacuaguaauaaauuauccuauuuccguuuccucaucuuuaaaagagaaaaggaguuccuacacuaauuauaguaauucuugugacacgagggucagacccagcucccagcauguaaacucccagcauguacugaccucacugcagaacccugauccugauccauggugguauugggacugccuaucucauuuuacaaaggaagaaacugaggugcaggaguuuuaaguaauuuggagaguucaugggcucaccuccagagccuauauuugaacuuuaaguaaccuaacuaauguaaaauaaagaaggcauuuuguguguguguguguauguauauguauggcaagaggaauccagggcaaugccucaaaaaaaaaaaaaaaaaaaaaaaaaaagaaaagaaaaaaaaagaaaagaaaaaaaagaaaaggacacaguagguagugaaauguaaaaccacaacuuagacaacaaugcuucauauacauuaauuacuuuucauugcuuuugcuauguuaaaaaaaaucuacaaacuucucagaauguuuugguaguauuaggaaagucuccuggauaugccauuccacuuggguaugaagaggauaguaugacuuaagguuuuuauuuuuuaauggugguuguugcuugcauaggacagaaauaaauguuagaugaauucugauuagauuucuuuuuuaaaucgcacacagccauuacaguaggucauauccuagauaaccuguagaauggacuaagaaauuuuaguuuagaguuaccucuugcauacugauggacaucaaggcccgaagggaaggacugacaucagaaucuuaauauaugauaugauauccaaguuuaugaggaauuuugauucauucaaccaugguuaaugaucagaaaugauagaaugacaaauagaaaacggaugaaacacuggcauguuguauauaggcacuuggggagaguagaagauacuagaacucuaguuuuuaugugaguagaaagcaguuucuagcuuaucuguugaauuuacaggccugcaguugaagaaucuguuguugaggauaugaaguucaguauuaagaugguuucuuuaauuuuaauuuauaauuauuugcaugugggaauguaugccgagcauagguggagguuagaggauacauuugugagguuucuucuuuucuuccacuaucauguggauuucagggauugaauucagguugcccagcuuggguaagcauuuucauguguugagccaucucacuguuugagguuguuuccuuuuuuuaaggcuuugauuuguuuauuuuaugugggugcguauuugccugcuuguaaguuugcccuguguguaugccgcuccaguggaggccagaagagaggggucaaaucuccuggaacaguacccacaaguggcugucagcugguaugugggcacuagcaauagaacucagguccucuggaagagcaugucuuccccuacccccucccaccagguuguuuguaaucuucaguauuguacaugaaaauuacagaaucaacaaaguugaaaaguaaucaguugucuuuaauuuucuggucagccuaauuugaaucuguucugaaucaacaucaaugaaaugaaaauauaguucuguauugauuaacuccaugaacacugcucaccucuccucacucuuuauuacuaggaaaauuaauuagcuugacggauguuuguccagaaugcuuucugccuaauguaguuccuuuacucucugguguuuuucuaacagagccccacccccugguuuacauguagagagggagguguauaucauaguuuguugucuggagaaaauaauuuuauuaguguuccgugaguguaugaguacuaguauucuuaccuguguuaccagagugaugagauaaacauguugacacuaguaaaaguuucagaggauuguuuuuuuuuuccucagaauuuaaauguaaaaguuuuugaaguguaauaagcccagcugacuugaagauucauuauggggugaauaugauaaaauaagcuuuuaccauuuguuugcaaauuagugaguuucagaguugauuaguguuuucuauuauaguacuguuuauugggacuuugguuauagguuuucagacuuuuuuguuuaucauaugucaaauaguuggcaaucaggaaugugaggauaaagggggaaaagauaguaauugagucuucuggaucagaucuaaaguaguagcaguauacagucucagaaaucagaaguguacugagguuaaaggacaguccacacaauucugacugcuuagaaauugacguagauaggugagggcaguguaucucacuuucaggagcugugugauaaagaauaaacuacuucguuaauuuucacaguuugaaaacuuuauuuuucuguguguggcuuuagaagauaaagauaauuaucuuuaccaaugugucuagcaugcauauuguaaauuucucaggguuugaaaacuuuauuuuugguguguggcuuucagaagauaagaauaauuaucuuuacaaauaugucuagcauguauauuguaaauuuuucagaguuugaaaacuuuauuuuugguguguggcuuuagaagauaagaauaauuaucuuuacccguaugucuagcauauaugucaucauaaaauguauacgugagaaaagaggcuccuucaaauauauaucauauuagagcagacauacaugcccauauauaucuguaugcacgcaaaugcauguacauauuaaauauuacaaauauaaauuuauauaaacaagcauauauauauauauauauauauauauauauauaugcauacauacauaucucuuacuuguaggagcauuuuaccaaggcuucaaaauaacagguuucuaaccccaggguuauguaaaauaacuuaauagucuguaaggaguauaagcauuuuauucuacuuauuuuuuuuuuuuuuuuuuuuguuuuuucgagacaggguuucucuguguagcccuggcuguccuggaacucacucuguagaacaggcuggccucgaacucagaaauccaccugccucuaccucccgagugcugggauuaaagugugccaccaugcccggcuuuugaguauaagcauuuuauaagagcauucucuguuuauagcuuuuaaaaguucaacguauuuaucauguauaauguuauugcauugcuauaaaauauauguuuuaauuuauaaauaaugggugcauggccaauuuuuuuucuagugauagagaugaaacucaaaaagcuuauagaucccaagugguagccaguagggaaacaagaauuauguuguguaggaaggggaauuggugaccugggguucauguugagggaaauggaaaggugaauggccagguggugcauuuacccagggaggcagugcuacuacaagagcguaggaucuaccaugcugaguucuuuaaggugaccauggggccuagaguuugggaauuuuccaucuaucaaugcugguugauaguauaggcugcaaaauaaaagcaccggaguguagaguagagaaggcucuugagaguagggaaagucguucacuuucccauuuucuuugaacuuuuggauccuuugccggccauuuuagagaguguaggaauuuguggggguuuccagcaauuagcauguuuaaauuaaagacuaguuuauuuuucacacccauucccccagagcagugaucagagcugcaguuugauugaggagaggcuucacaugggaaaccuggcuuucagugcaggugcugaaccuggauuacuguaugacauuggugcaccacucccuagggcuuugguuucacaucugcacuguugcucucacuuugagauaagagggagugacugccugaucuaaguacugaagaguacaauuuuuguuuuuucaugagaaaccauuuucuuuaaauuaaaaaaaauacuuuaaauuauguguagguauguaugucuucauaugacuuugcacacaugagugcaaguuccuucagaggccagaggcuuuagauuuccuagagcuggugcuauagaagguugugagccaccuaauaggagcuaugggaagucugggaauugaacuuggguugucuggaagagcagcaaaugcucuugacuguugagcccucuuuugccugagcaaccguuuugugucauuaugagaaaguauagaugcugugcaauuaacacugguugugccagggcugauuugucacgucuguaacuggcugcucuuugucagggugucuuuaguagugcauugcauuguagcucgucaguguacugagucauugccacugcaaagacaugugcucaaagaguguaauucaggggucggcaugucuuugauuuugaguaaauucccuagaugguucaauuguguuccacucaggaaaacaugacaaagaauaguuuauacagugugccaucccagaugauacucucaguuuuuuuugaagaaaaggucagugguggcuuaagugguuuuggaaggcuugauggagaagaugaggucugagugaggaaugggcugaugggugauaugaaagauguauuuaaaaaagagcaaaagaaaagaaacaaguaaaagucauaaagguagaagaauuugcauugcauuuugcuuaaggaauguaguuucaaguggaagggugaaaauauuuacaugcaaauucugguaaaugucauuagaagcacagaacauauucagucuauaugcuuauugaauguuuaauuucauacucugaaauuaggaugcaaauagcuuucuaaugccuccaguauuuuauagacuauauaugauuuauuuuauuauuauuuuuuacccuucuuagaggucaauuguggaauauuauacuauuugauaauuaagauauugaaguuuguuggacaucagugggaggagaggcccuugggccugaggguguucagugccccaguuuaggggaaugccagggugggaggaugggagugggugggugggggagcacccucauagagcagggggauggguuagggguuucugaaggggagaccuggaaagaggaaaacauuugacauguaaauaaagaaaauauccaaucggaaaaaaaaaaaaagauauugaaguuugaaacuacauuuaguggccuaauucuacauuuggaaaauguaauaaaauaaaauaggcaugaguuauccugauuaaagaaguauggaagcaugacuuuaaaagaauuggaggugucucuuguguucauacuugagaggcccuggguucaaucucuagcacagaacaacaacaacaacaacaaaguugagaaacacauauuaaggaguuauucagaucccgcccccaguguuaagaaaaucaguauagaaauauuuguugcuaaaacuuuuccaucagggucauauuuuauccuuucccaaauucugaaauaugcgucacuccuagccuagucuugagucaaaugagaaaugaaguaacuuaucuguagcuuuuuuuuuuuaaacauucuuuauuuuauguaugaguacacuguugcugucuugagacacagcagaagagaacaucugauccuguuagagaugguugugagccaccauguaguuguugggaauugaacucaggaucuauggaagagcagucagugcuuuuagccacugagccaucucuccagcccuauaguuugauuuuuaaacauuuguuguauaaaguaugccuggauugugcuuauuccauccacaccaggugagagaaggaagauaggauaaaaggugguggucaaagugaacuuuuauccagaaaaauuuuuuggaaaccaguagauaagauuaugcaauauagaaauguaacucaaaauuccuccuaauugaaauuauguauagggaaaaugcuuuugauaccauuaacagauaguuaacuuucuuuuuuaaagauuuaucuauuuuuauguuuaugugccugcaugugugcaugugaaccgugugaaccgugugaaccguguguguguguguguguguguguguguguguguguguguguguguguguuuugcucccagcagaggcuagaagaggguguugugauuuucuggaccuggaauuacagaugguuguaagcugccaggugugaaugcuugggaucaggaccuaguugcucugcaagaguagcaaguacuuuuaagcacugacccuucuuucgcucuagugcccagauaguuaacuuuugcaagaccucuuacacuuacauuugugaaauauaaguuuugucaacugaaacauuugauaauuuuccucauucauagggaaaaacaaaaaacaggaaagaaaggauaaaauuugcauauguagaaaguauaaagggaucgcuagcuuagggaccgcuagguuaguucguaaagucucauuugcuagguaauaaggaugauagcagauggugcugggcagcaguuuuucuucucucacuguagacuggcuguuuauguuuucguuuuauagcuuuucuuaaaauguuuuauuuucaaaauucaucuguagccauacuuuuggggcuacuuuauuggguucuuauauuuaccacacuccucuacccuaguuccuuccaaccccccuaauacuaacuagguaguugagaagaagguuagaggggaaagggagcauagaccuaguuagacuuccugcugauuaggggcuucgagguucuuggacaaguccaaucuucaugguuagaauaucucuagccagcaaccagcaacucaggauucaggaaccagcaguucagcaauagcuaaagcagcagcagaaccagcagcugccaccacaggcucuuggggcacucacacuuacacucucucaagaguccccaaaauuccaaauguagacuauuugcagcuggcaaaaucacacuucugcagcaagagagaaaucauagugguuguggacaaucugaaguggucccauaucccacaccuggggauuaaaacaaaaacauauucacauaucaauacuggguuuuuuaagaaaccaaaauucucacuccuuccaucauuuggcagucauuagauuaacuuuguagugacugauuugaauucgacacuugcccuuggggcugcucuucuuucaggugaggguaguggagguagaugucaguugucugucaccacacauucugucuuguuggcucuuccuuuccuuugguaguuuguacuuugugugacaccucagguuugaucuuguuuuguugauuauauuccuggagcuuaugaguuuugaagaggacauugauacucucauuuuccuugggauaguggaaucaucaguagucgugaauuguauuuuuaaauuuuuuuuuguguauuuguguugcgagugaacuguuuuuagagaucagauuuuuuuuugugagcuuuggaucaaacuuauuaauuuauuauuauuauuacuguuguuguuauuuuacuguagcauaaccaaccuagaacucacuguaugaaacaggcuagccucaaacuucuagaaauucucuuacuuuagccucaaaguacugggauuacauacagcaugaaccauuguacuuagcuucaaacaaaaaccuucauuguaggaguuuauuaggcucagacaaauguuuuauugguuagaaaggauuuucauugaguucuucaaaagucuuuuguuugcagucaggguagaguuuuggcuggcauuuaagaagcugucuagggagacuguuguguacuuauaggaugguaggcugcagugaggugcuacuaacauucccaacuuagccgggcagugguggcucacgccuuuaauuccaucacucgggaggcagaggcaggcggauuucugaguuugaggccauccugaucuacagagugaguuccaggacagccagggcuacacagagaaccccugucucgaaaaacaacaacaacaaaaaccccaaaacaaaaaaccauucccaucuuagguuaccuagccucuuuuucugacucuacuggcuguuuuuuuuuuguuuguuuguuucaauuugacauaaguuaaaguuaucagagaguaaggagccucagcugagaaaauggcuggugguccuagguucuauaagaaaguaggccaaacaagccaugggaaguaagccaguaagcagaaccacaccaugaccucugcaucagcuccugccuccagguucugcuuaaauuccuguccucacuuccuccaaugauggacuaugaucugaaaguguaagcugaauaaccaacccuuuucucccuaguuugcuuuuuggucaggguguuuuuugugguaguaauagaaacucugacuaaggcacuguccuuguuuucuucuuccuuguguguaagcauaauguuuuuguguaguguguaaagauuauccuuguauuauucaaaugcugauuucucuaucccauuaucuguuuucaauccagacacagcauuggggaguguuuaauacagggucuugcacacaccaagcuaguguuuuaucacugagcuucaucuccagcuguuaaguacuucauuuugugugaacuggcuuauacauuccuuguagaggccagaaguugacagaggauguguucuccaauuguucucuuaacuuauucuuuggagaucucucacugaauuggagaugagauuuggcuguuugaauggaauugaggauguguuccucccucaucugccuauaugagcagaaacugaguagcaaccccuugguguccccuugccuuugccugcccacuccccauguuaggauuacggacacacaccauugacacucagcuuuuaacacaggugcuagggauuugaauugagauucuaacuuugcagacugagauaucucccuaauuuuaaagucauuuuccuuuuaagaguaagugauuucuacaaaaauaguauagguugagcuuccuuuaucugaaaaauuuaaaugguucagauguaaaucucugaaugucaacaugguacaaaaaauucugcaccuaguugucccuucaggaucagugguaugcagguauuauccaguugaauacuuaauacucaauacaggcauguauguaaguuacauaaggggauuuuacauuuagacccaggucuaaguuucacuacauguagcuauuucaaaaucugaaaguccuguacuuuuggcccuaugcaguuugaauaagggauacuuaaucuguauauaucaagcuuuaaaagauaucauuuguaaagggagugcacaucuuuaaccccagcacuugggaggcagaggaaagcagaucuuugugagucugaggccagccugaucuacuccaggucagucagggcuuuguaaugagacccugucuuaguaaaaggaaauaccagauguuauuuauauuuuauuaaaaaaauuaaguguuuaaaaguucagaagggcuuguuuacuuugaagauuaagauaguuguauaaauguggggcuguuucuuacuuaagcuauccuuaagaauauuuugcucagggaugaauuaugccaccuuagauaaaaauugaauaugcuuuaaaaaaucuuaaugagaugcuuuugugggaacaagacacaaaaccagcaucuauuuagaaauuaagauaacuuguuggccuccauucacuuugaauguuuauuaaauaaacucauaaaacauuauaagcuuuuuuuuuucauuucuguggucugagucaauucuaacucuagauccgucuaaaauaguggcuaaauaggccuucaaaaaauauacuuaaugaagcucaaaaucaggcuauagcuucugaguucagaagcucaggugacaauuucaucuguaaagcagagaugucuccuuucugagcuccugaguaaugucagaagacaaggucguauaauuuaauauauuccagcauaacauuuugaguguuaucuuuuucucuuuccuuuccugccuccaaaccuuccuauauacucuucugcucuccuuuaaauucauagccucuuuuuaaaaacugauucuuguugcaugcauauaugugcaguauauauauauauauauauauauauauauauuccuaaauauaacuugaguuuguauaauguuacauguguguauauuuucagggcuuauuguuuggcacuggacagccaauggguguguucaucucuggggagaggacuaacuuuccccacaacagcuuuccuuaguugccuauaguucugugcuuuucucaguccauuggugucauccuuguucagcucauguucgggcauucauguuggagaggcuucauggauguagcuucagauguuacuagaagacacaagcuaacagcaaauguucugaucaucuggcucuuacugucuuucugcugccucuuccucaauguucccugaccuuuagguguuuuuguagauguaucuauugggacugggcuccacaacucuguauuuugaguuuuugugguuuucuguaguggucuugguugcaaagggaaguuuccuuggugaaggaugaaggcugcacuuaucuguguguauaaggacagacauuuauagauuagugauuauggugguuugguaaacuagagauaguagauucuccuccaauaacuaugacuucacaacaacugaguaguuagcuagauuuccaguagcaagcaugguuucucucuuguugagauggugucaauuagacuuaauaauugccaauuagacaauaaccaaccagguuaucuccauggugccaugcuguuuguugugguuuguagauaucacagcuggguagaauucuuguuuucuucccucuuucugaagcuuacauggugcuuuuugguaccaugaaagcuaguccucagggaggggacauucagguugaguauuaucuuugagccaaguacuuguugcuauauuugugacuaagacacuaagaucuuguucucuugccccacucccaccccaccugauccguugggggaaagaccaauauuaaaaguaguuacagaugaguaaaauauuaggaugcaccucuauaaauuagugcguacaguggcugcugggcccacaucucuucuccauaguacuauugcccauuuuccauguccucaguuaucuugguuuccaacuugaggaggaauugauaggggaguggcuuuguuguggugaaaauuagugugccuaauucagagugauacauucccaguagucugagugacugcucugcuccaggguggacugucuuuaucauuugucuuuuucuuuuccauguuuugacuuuuaguauccucucagccuucuuuucuuccugaguuuucauuucuucauaacaccaugcaugcucacuugaauaaugaucucuucugugcauaucucuaacuccagccuaucucccgagauccacaucuguguccccacuuuccuuaauuaaacaaauaucauaaccuauaaguaauuaccuuaaccaccuaacuguagacuuguuugcauuuccucauugcuauugugguguacauuuugacacaauggcuuuuuuuuuuuuuuuuuuuuuuuuaagauacagucuuaucauuacaccauguuauuucaugcuggccuuugauucucauucuucuugcuuuaauuuuucuugaguguuuguauuauagacaugaggcaacacaugccugugacaugugugauaaacucugccugccuguaaggcgucgucccuauccuggucuccccuaauuuccugcugcuguguuuauauaaucauguucuaucuugccacaggcuuuucugcuucucaauuaugacaauaaacaaaauuuaaccucuuguaaucuggcuccugcugcguguuugcucuuacucagcuccugcuauuuucagugcauaaugcaaaucucagaacuacuuuuaagauuuuaaaaauauaauguguauuuaugauagagacaugguuguuugaaugaaaauggcccccauaggcucauaggaaguggcacuauggaguugugcccuuguuggaguagguguggccuuggagaaauugugucacuuggggugggcuuugagguuucaagugcucaagccaggcccagugucauccucucuuccugcugcuuucugauccugauguaaaauucucagcuaccucuccauacucuacagguaccauuuguaccugcgcuaccaugcuucuaucuugccaucuuccuguaguuagacaguuaggugucuuuacacuauguccuguguugauguaaaacacaguuuacaccucaaaagaucccuuuguccauuguauucuagagccaaauaugacugaccaugaccuggaaacacagauuuagguuacccuagauuccauguuccaguuugauauguaguuuuauguaacagaacaaagaaaaccauaaaucaaguuacuucuaaguacagugguggaaggaaacguuagagagauggguuagaacaaaguagggaaaucuggcuucagaugcuagcugguggaagcugaucaucuucuaaguuaauacauuccaaaggauaacuagugcuauguuucuacauuccaagugacuuaucuaauggagggcuguauugguuacuuugcuguuuuggugauaaaaugccaugaccaagauaauuuaaggaagaguuuguuuuggcuuaugguuucagaagaguaagaguccuucaugcuggaguggcauggcagcuuuaauaagaaauugagaaaucacaucuuuagccacagacaugaagcugagagcaaacuggaaaugguacaagucuuaauuucaaagccuguucccagugauauauuuucucuagccauacuaaauuuucuuaauagggaucccacauagagaucaaguguucagaugcuugagccuauggggaacauuucuaaugcaaaccaccauaagggcaauagauggcuauuaagaggguaaagauggcacaaguuuuuagcucugaacuugcaacauuccaaauucuccagucauugaagaucuaaucagucugucagccucauagaugguucaauucaaaaugcagcuucuuuuggagauuuucacuuacaguuucuacucuugagcauaucucacauuuuauauaugugguagccacauuuuacuuauuaaauaucauucauaucuccuuuuuaaggaaaggcucauuaagaucugauguagaucaaauugauuaguaggcaggugagcagucuuuaaggggagaagaauaccugguaucauagcuucagcugucaaccuaacacaaaccuagagucaucuagaaagagggaacuucaguggaagaguauucuucuucuggauuggcuugugggcauguuucuggggcauuuuuuugauugcuaauugacguaguuuggcccguuccauuaccagcugugcugucccuaggcugguagaccugggcugauaccugagcaaaccagaggaagcagcccagcaaacaguguuccucugugagugagugaguucgugcuugugcugacuuccuucagugauggaccuggaaguauaaaaccuuuuacacuuccuuuccucccaaguugguuuuggucaguguuuuaucacagcaacauaaagcaaacuagaacauaugguaaaagccauuaaagggagaaaaaaaaaccuucuagauuauaucauuaaaaucuaauagccauuaugguucagaucugauuuuuuaauuuauuuuuuauuaaauuaauuuauuuuuuaaacuccauauuccauuccccaccacaucccucaucuacccucugacagcuccucaucucacaccucccuccucccuccauguggaugaccucaccccccaccccacuugaccuuuaaacucccugggaccuccagucucuugaggguuaggugcaucaucucugaaugaacacagaccgggaaguccuuuacuguguguguguuggggaccucauaucagcugguguaugcugucuguuuugugguccaguguuugagugaucuuggagguccagauuaauugagacugcugguccuccuacaggaucguccuucuccucagcuucuuucagccuucccuaauucaacaauagaagucaggugcuucuguccauuaguugggugcaaauaucugcaucugacucuuucagcugcuuauugggucuuucggagggcagucaugauaggucucuuuuuuugugagcgcuccauagccucaguaauagugucagguuuuggaccuccccuugagcugaaucccacuuugggccugucacuagaccuucuuuaccucaggcuccucuccauuuccaucccuguaauucuuuuagacaggaacaacuauaggucagagaugacugggauggcaaccccauucucacuugaugcccugucuuccuacuggaggugggcucuguaaguucccucucccuacugucaguuauuucaucuaaggucccucccuuugauuccugagaguauuuuaccuccuaggucucuggugcauucugggggaucccuccaaccuccuauuuccugagguugccuguuuccauucuuuucugcuggcccucagggcuucaguccuuuucccucacccaauaccagauaggucucccucucccccuccacuuucccucccaggucccuccuuccccccccccccccccccccacuugugauugguuucuucucucucccaagugggacugagucauccucacugggcacuucagcuuguugaccuuuugaccuuugaguucuguggacuguauuuuggauauucuguuuuuuuuuuuuuuuuuuuuuuugcuaauauccacuuacuagugaguauauaccaugcauguccuuuugggucagaguuaccucacuuggaugauauuuucuaguuccauccauuugucugcaaaacucaggauauagcugaguagaauauuccauugguaaaugaaccacauuuucuguaucuauucuucugccgugggacaucuagguuguuuccagcuucuggcuaucauaaauaaggccgcuaugaacuuaguggaacacaugccccuguggcauggugggacaucuuuuuuuuuuuuaagguuuauacuuuuuauguuuaugcguacauuuguagcugucuucagacauaucagaagagggcauugaaucccauuacagaugguugugagccaccauguggaugcuggaaauugaacucaggaccucuggaagaguagccagugcucuuaacugcugagccaucucuccagccccagaucugauuuucaacugucuauauuugauauaacaugggaucuauauuagaguaauauaugaaauuuaaaauaaucaagaauauugucuggacuaaugaaguuaacagcaacaacaacaacaacaacccugaaguagucuaauugguuguauuuuuuggcaguaauaauuuggauuuaaaauacacuacuuccaaacuggagaguggguuuuugguuuuuguuguuguugaaauguuuuuaucaguugaaaaacuagauuucuuuaacccagauaaaagcgaauaaugaguuuuuuccuuaaaaaacacaaaaauauuugugaauguucuaaacaugaaaacaagauuuaaauaagguagauguuuaggauaaguaaaaagucauaacaaaaaagaugauuaugaaaggaaggauauuggggcuggugagauggcucagcaguuaagagcacugacugcucuuccggaagucaugaguucaaauaccagaaucuacaugguggcuaacaaccauccuuaaugagaaacaaauaaaaaaccuaugggcuggaucgagugggagggauggggggaaagaaaggaaaaauaucaugaauucaauaaaaacaagauuagcauuaauuuaucacuuaugaguauaccaagugaaauacuaaauacacaaagauaucgaauucuaaaaggauuuuaagaaacaaaaaaguuagagaaauguuuacauuauauuacauggggcacuugaguaucagccagaauuuucuaaaugagauuaugcuuauacucucagaugaagguauuguguauuuaauguaagaaacgugaaucagaaagcugauuucauuuguaaucuaggaguagguaagauauaucuggauagaaucuuguuguccagucagaauggaguuguuuaugaaauaaauaucugguuuuucuuacucuugaaaaagacuguaacuaguucugcauuuuaguugucacaauuaaaaguauuuguuuuuuuaagcgaucacuuguuaacauuuuaaagagcauaucagaauagaucaauauuuaaggaaaccuuauuguuauaaacagaaucaagcccugauuuuaucugagguuauuuaguuuugacuuuaaaaauuugaugacacacacaaaaccauagucacuuucuauaaguuucauuuugacuguuucuacaacauacuuuaaucuuuagaaauaauccucauagaugaugaagaguugucuucagugagaugccauugcuagggaaccucuaagccccauuucucuguauagagucauuuguugacaggccucgcauagcccaagguuauauguuauagcuuuaugucugagaaggacauccacgugaacugugauguagucuuucucaagccuucccccauucugccucgggcaggcacuuugguccagauuccaguugugccgccucccuaagggccacucucaaguauggucucagucucaugcucccagcucuugcuuucucauuacugucauuguccuuagaguccugcugaauucuuacuucuuccugucccuaaaacccagcauuuaugaaagccaccaagcaauagcuccucuguuuccugcuggcuuacagauccuuacagaagaguugaugacuaucuccaagauguuuggagacaguccuaguucucucagcaguucuugaacacuagaacuuuguuuugucuucuucugagcgugguggcacacuuccagagguaugagggcuuuaguaaguagguucuuuggccuaucaggauacaaagaagcagaggucuguggcacuuacaguaaugguuuaaaguaauguauuucagaauauuggggaacauuaucuuuuucauucuaucauaguuugucucucugacuuguaugguauuuuggaagauuucucaaggcugaucagcaaguauuaagguagccugaaggaguauauccauccucauacugugaucauccacuuccacuggagugacacguucucuguccuuagucaucaguggcucuauugaaauuguugagaauuucaaccuguaaugauuuacaacauuguaacccuaacccuuagaacaucauacauuugugacacucagguuuuauucacuucuuggaugcagucccaagcuaucugcaucaaccugucagccccaggagagacucauuuccuggaggaagccugauugcggguggaugacucccagagcuaccucucuugucucugggaagucuaggugagcaguggagcagaaguguuuaucuuaagauuaggaccaugucucaaugcacaguagcaugucugccuuuacuucucauaugaaagggaccugagaccagagcaaaguuuucugugcuuugggaagagcuguucuuuaaaagaaauacucaggguuaaaauagaacuaaagaaccuuuccuuuccuucccuucccuucccuucccuucccuucccuucccuucccuucccuucccuucccuucccuucccuucccuucccuucccuucccuucccuucccuucccuucccuucccuucccuucccuucccuucccuucccuucccuucccuucccuucccguuccuuuccuuuccuuuccuuuucuuuucuuuucuuuucuuucuuuuuuuuuaaagauaggucuugaacuuaccaucuagggaaggaugaugaacuuauacgucugauucuccugccuccacuuucccaauguucuuucuuuuccuggguuucaagacagaauuuuucuguguagaucagacuggccuuaaacuuaugguaauucuccugccucugccucuuaaauucugggauuaugcccaugccagcauuccuuacucugcuuucauucugugggugagucagauguguaugcaugugcacuagacuggacaugccuaugaacagaaggcaguuaacauguuagcugaguagucugcagucucagcugucuuugaacacauuugguuaggaaugaaaacauugguugaauagaaauagagagaaugaauagaaguugccuguuuaauacauagaauauuaucugaucucuuuccuccucaccuccuaacccugagauucuaaaggacaauacagauucuugguuuaauaaggcauuuugcuguagaaaguugagggaaucaagcugaguauuuuaccaaucccaugcauaguuaauuuucuuacaaaagaaaaaaaauaacagcaaagcacacagaaaaaaugagucagaaccuugaauaugaauucauguuuuagccugaggagaaauaaaaacucuuugcguugucagcaugggaugaaugauucagugcuggaaaguacucuugguucugagguaacugggccucuggaugugccuauuagguugagagccccaggagacuguguagauggacauucuacaggacaagccgccacagcuuucugcuguaggaauacuaacuuugguuucuuuagaauguauguaauuuuguaauguuuaauugaaugcuaagacauuucauuuagagacgacagaaacacauucugcaaguguggugugaaguaggugaaagguaaccaucuggaagaaaggcagauggcaguguagagauguuuggagagaaauagauugagaagaaaaagaagggaagguggaauguaauauuuucucuaucaauaauaauauacauuuucuguuauagaugaauuugcaacugguuuccuggauuggauugaucaguuugauuuguucuguauuuggccaaacagguaaaaaaaaagguucuugguuuuuuguuguuguuguuguuguuguuaucuuuuuauuucagcaucuuguaucaauagucauuggucaguuagauucuagagggaagggcaacccuccaucagaucacaacacuccugaaaauuugcagcaucgucucacugugaaugaaaaacagguuuccaaggagccugcaggggucuucauuaucaguuaaucaucccugacuucagugugaggauugugagagcucacaugacaguaugucauagaccacacaaaaauaauuggagaaugugagagugcuggagagggaccagaacaaaggcagagacauguaauauauuuagaagcaaauaaaauaaauauccacuuugguggauuacaacgaaaguguguccauuagcaucuaaaaagggaaaguaggcuggacaugguggcacaugccuguaauccuagcacuuggaaggcagaaauagucaggagaaucaugaguuuuaggcuagccugugcuagauacaacccccccuucuccaucccccaaauuaaaaaaauccuagaggguuggaauauaguucagucaaagcucuauguuuggaguggcaaaaagaaaaaaaacaaaaccaaaaaacuagagagagagagagaaggaagaaggaggaggaagaagaagaagaggaagaaaacucagaaguuuacuuucuagaagaaauucuuguucugugaucaagaagucuuguauuagcauaucuauaagagcagguaacaagcugaagauaguuuaaauuucucugacaaccauaaccaucccuuguucuacugucuaugucuuaaaaaagcauaguauauaaaauaauuagaauuaucucaucucaagauggacaugugaaaaugaugaaagauacugaguaggaaaugauacauaaaaucuacagcccccagaaacuguauccugaggacacaccuaaaauugguagggugguuaucuuaaauuuuucacuucaagcauaguuuauauucuaaucagaaaacuggagacagucuuucuaguauuuacuacaaguaaaaaugugccagucuagauugagucaaagaaaugaaagcucaauugguuaugaguuggaugaauaugggcuuggcaguuauuuaacauacuaaaaguggaguggaagcccugaagacauuuaugugguaugggcaugagauugucagucauaaggaaaaggcaauaccugaccuagguauaagaguaccaggacauuuauaacccgcagaacaauaggugcugaaauuacagugucaacaguauggucuaaugguguguagcuaggcuaaugguauuaguacuagugugucaugcaaaaagacaagaugauugccguuugugguucucagugucaaggggaccccaggucauuagguuuucuuuggaguagccugguauagcuuaguaacugggcugcauuuguucauuuuuaacauguauguuuauuugcauauuccuggucucuguuuuucuugugaucuuuucauuuuuuucccuuugaaacuuuaaagauacugaaaaguacaguguuuuuguuucuuuucuaacagauaaaaauagauguuuaaaagcaaaugccaaaucuugcggagaauguauacaagcagggccaaauugugggugguguacaaauacgguaagauuucugauacuguucuauuuauucucugauuuuuagacuuauucagagccuuguccuugggaagugucagauaagauauaccauuuuaauuaauguuuauugaauaguguauaguagucagaauuaugcuguuugacaaaauacuugucuuaguuaauuuuauuuguugugacaaaaaaccauucuuaagguaacuuauaaaacaaacaaacaaaacauuuaauuugcggcucaaagcagagugucaguccauggccgucauggcuuugagcauugccccagacagacagacauggagcuggggcaguaguuaaaagcuuacauccugauugacacuaugagguagagagagcuaacugggaaaguugugggaauuugaaagcucaaagccuaacuaacuucagugaaaggaaauauaugcaaauuugaguucagaguuugcuuaaagauuaauguacuuugucccuucuauaaugcuuacuaaaauuguauugaauuaauuugagguuauguuaggucaaagguucuuuguauaugucuucacucagcuguuuggacuuguaagaucaacucugacuagguaaguuucaacuauagauucaaacaaugaucccauaaaaaugaaugcuguuggugccagcagcugccagauaaauagaaccucugaaguaaaccugucauaacaugaucugacaaagugaaauauaaaaugagaaguuuuugucuuauuucagauuuuuuuauacuacaaauggugcacuggggugaaacuggggauauuuaggaaaguccaauggaagcucuugccuuccuucuuuggaaaaugaggaauaagcucaugcuuuaccaguuguuacaguuagaaaugcuggauuaaagagagggguucauuucagaaguucuguuuaucuggaagcugcugacacagcguucauuuuauggguccauaguuuaucuauaguugagacuuagcuagucaaaguugaauacuauagcuucugaaaucuagggcauaacuucucaauuacuaaaggaucuuguggaauauguucaguggaauuuuauuuagguguuaugaggcuccuugauuggucaaauauuugggaaugggccaggcaucguggcucaugucuuuagucccaguacucaggaggcagaagcaggcgauaucugugaguucagugccauccuagucgacaaagcgaguuccaagacagccaaggcuacacagagaaacccugucuugaaacaacaacaacaaacaacaaacaacaaaaacaacaacagcaacaacacccaaacccaaacagaaggaaaaggauucccucagaucuugugcuuuguuggauuuugagauuuaaaaauaaacaaacagauuucaguuuugaccuuucauccuggucauucuuuccaggugucucuuuguguggauacucuugcuauguuacuuuugccuaaaaauauacuuuuaccagccauuaucuguucuuagucuugugcuguauauguacauucauauguguccauugaaagugagcaacaacagguuaucuucuccuauugcuuuuuaacuuauuuuuuguuacauugaaccucauugaaccucgggcuugcaauuucagcuagauugguugaccauuggguccccguucugagaacccacuguuuuuguccuccauuauugugggcccagguuacagauguucacuaccuuaugcagcuuuucugucagugcuagggagcaaaacuaagguccucauguuugcaaagcaagcacuuuacccauuaagccaucuccucaauccccaccuuggguuuuuguguauuuauucguacaguauuaggaccuuuaaaaaaguucaagauugucuuaggguuuuacugcugugaacagacaccaugaccaaggcaacucuucuaaggacaacauuuaauuggagcugacuucuagguucagagauucaguccaguaucaggcaggagcauggcaguguccagguaggcugagaguucuacauuuucaucugaaggcuucuaggagaagauuggcucccagggagcuaagaugagggucuuaaaacccaugcuuacaaugacauauuuccucucacaagaccauaccuacucccaacaaggccauauacuuccuaauagugccacuccuugggccaaacauauuuaaaccaucacaaauguaaaauauaaaaaucuggggagaaaguugugagaaaagcauugucugcccuucuagugccuauucuuagcacccacaucguggcuuacagucacaaggugucugacacccucuucuggccucuguggguacugcacacaugcgguauagggauguccaugcaggcaagacacucaaacaaauaagauacaauuuaagaaaaacaauaaaaauaucucauuuaguagcaagcauuuaaaagauuuaguagcaagcauuuaaaagauuuuuagcucgucagugauggcacaugcauuuaaucucagcacuggaaagacagaaacaggcagaugucugaguuugaggauagccuggucuauauagaguuucaggacuacacauagaaaccuugucucaaaaaaguuuuuauucaggaaaguuuaugcuaugcuuuacacacacacacacacacacacacacuauuaauugggauguauuuaggcuaaugugguuuucuuaaacgccuaguuguuuaaaaugcuuugcugggaaguccuucaaaggacuuuucuaagagaaaauaauauugucuaaugugugggcuuauccauaauuaggugcugcuaaguaugccaaacacugaaggauguaguuaguauugacauacucugaauuugaaaggugaggcuucuaaaauaugcauaaagccuggggaaagauaggacuuuuucaguugguuuuacuuguuuuuguguaagagcacacacauaccacguuguggauuuuuguuaagaagcuagaaacgaacuaccuuagauuaagucauuugauuuuuguaauuuguuuacaugcaguaaaaaacaucaaaauacuugcuauacuuuuuuuguugauguauuuuauauuucauuuagacauuuuugcaagaaggaaugccuacuucugcacgaugugaugauuuagaagcuuugaaaaagaaggguugccagccaagugacauagagaaucccagaggcucucaaacuauaaagaaaaauaaaaaugucaccaaucgcagcaaagggauggcagagaagcuccggccagaagacauuacucagauccaaccacaacagcugcuucuaaaauugagaucagguaccucuaucccuaccugaguuuuccauagcaaguuuauacaagccuuuucccagucuuuugaugguucauuugggugaacugguaccccaaauagggcauaaguuaaauuuuagaggacauaaccucuuuuuguugcuuuuugcuguccuggaacuugcucgguagaccagguuggcuucagucucagagaucugcuugucuccucuucccagaugcugggauuaaagguguaugccacacuuuugauuccuggccacaauuuuuguaagacauauuacuuuuaauaauuuaaugauagagauuaaaguuaagagugaaauguucucuguguaaaggcacugcuacacaaaggugaguaacgaucuaguuuuacuuuagaguuguaaaaggaaguuacagaggugaagucauaauuacaaaaagaucaaggaaaaaaagaugaagccuaaacugaaaaaugaggaaggcgagagagguaaaaguuguuacauguuauuuacuuaaaaagcacagagcuggaaggcagcuuagugguagagcauccaucuguuaguauaauuucauaauauaaaagcaaaguuuuacuuauuuauuuaauguauaugaguacacuguagcugacuucagacguaccagaagagggcauuggaucccauuacagaugguuugagccaccaugugguugcugggaauugaacucuggaccucuggaagagcagucagugaaaagcuaaguuuuaauccauacaucguuuaguaccauuuaaauacuaacgauuuuauaagugcucauggccaucccaccucugaaauagacaacaugcccucuuucugccugucauccuuccauccuguuacugcugccuggcuaaacuucagccuaggaaauagacauuguuauaguuugaaugugaaaugucccacuuagguuccugcaugccgacuuuuguucuuggcuuguagugcuguuuugggagucuguggagccuucaguugcugaggcuugacuggcagagugugugucucugggggugggcuuuaguuuccugaguugccaagacauagagugcuguucccucuugguccugcucuaacuucugugaccuucuugaaacugagccaaaaauaaaucuucuuucuccuaaguugcaaugucaggaaaaguacuuaguacagacuucuuguacauauacuguaguggaauacuacuaucauucuuugaccugcaggauccugaucaggacauugauuauguauuugccuaagucacauuuuauuuuaaucaucauuacuuaaaaacauuuuuuagguuuacuuauuuuuuauaugcacauuuugccuguaugaauacaugcauaugugcaccguguauguaccuggugccugcagaggucagaaguuaucagaucccuuggaacugaaguaugguuaugagcugacauauguuaggaguugaaccuggguccucguaaaagcagcaagugcucuuaacuucuaagucaucucuagccccucgucguuacuccuacuguggggagcuuguaagaggcucucuucuuaaacuuaggaguccaugucacugcugguuuuucucaguuccuuccauugcuuccaauuuccuuuuuguguuuucuuccuuucauccuucugcaaauuuagguaagacuugguuuuccucucaucaucauuggaaaucaucauucagcaaugacauaagcuuuuccguuuagcucuguaccuguucuccagcugccugccaggaagucagggaaaaaagaucguuuuucaucuaagcagaccuuccauuuucucccauguuuguguuuuauuuugugguacuggagauagaauuuaggaucucucaugugcugggcaaaugcucuaccacuaagcugccuuccagcucugugcuuuuuaaguaaguaacauguaacaacuuuuaccucucucgccuuccucauuuuucaguuuaggcuucaucuuuuuuucuugaucuuuuuguaauuauggcuucaccucuguaacuuccuuuuacaacucuaaaguaaaacuagaucguuacucaccuuuguguagcagugccuuuacacagagaacauuucacucuuaacuuuaaucucuaccugucuagaauguaccuuucauucugccaaaacucaugguguucugauuuucucauaaguuuuuguguaaaucaccuugugguuacaguaacaacuacuugaaauacauguaaaaagaaaagcuuauuuugggccauaguuuuagaaguuuucaucugacggaguggccuguugcucugagcuuguggugaugugagaugucaugguggggcaucugggagauaagacagaaaggaggucccauagacuccagggcacaucacugguaacccaaaccuccugcuaguccuuaccucucaaacuucccacugccuccugaaaguaccaacacaugggcagauccaaacuguagcagaauuauuuguauuuuguggguugcuggagagggcauugccuucaucauuuuugccuccuuaggucuuggaguuguaaaugguugguuaaacgaaaucaagugugccuguugaggcgcuaacaaaauucuuagauuuggaaaaaauauacacuuaagacuauaucauugaacauguaaauuggacuuacuuuuuuucucauuuuauuuugauuacuggccaucuaauuucaguuuugaaucuuguuaauuaggagaaccacagaaguuuacauuaaaauucaagagggcugaagauuacccuauugaucucuacuaccuuauggaucucuccuacucuaugaaagaugaucuggagaaugugaaaagucuuggaacggauuugaugaaugaaaugaggaggauuacuucagacuuccgcauugguaggaauguugggaacauuuuguguguguguguguugaggggugguucugcaugugugcagagcaggcuauugagugucuuauguuaucacuuugugucucauuucugugagacacaguuuaucacuuaccuagguuuguggccuauaauuuccugucuuuuccugcagcagugcuggggugcaagguguguaugugcacgccuggccuuuuaccuggcugcuaggaucugaacuuauccucacgcuaaugcagcaggagcucuucccacagugcagucccugcagccuccauacugggcuuuagaaaaagaugugcauuuagaguuggugagagauggcucaggggauaaggguccugccuuuaagugugaugacugagcucagucuccaaaaucaguuccugcuuguccuuugaccuccagacaugcauugugguauaugugugcacauccuucacccaaauaaauaaguaaauaucaauuuaaaagugauguaaguuuguuggucucuucccacucaucuauccaaguacauucuuuucuuuaggcuuuggcucauuuguggagaaaacugugaugccguauauuagcacaaccccagcaaagcuaagaaauccuuguacaagugaacaaaacugcaccagcccauuuagcuacaaaaaugugcuuagucuuacugacagaggagaguuuuucaaugaacuuguuggucagcaacgcauaucuggaaacuuggauucuccagaagguggcuuugaugcaaucaugcagguugcgguuuguggaguaagugauuuauuucuacaggggacuguuagcauugucuguggggauuuauuuuaaguguuuuuaauaaaaguuagaacaaaaggaccauagcuacuauaagauuaccccgaggagcacugaugucaguucuuacguucccacugcugcuuucucgggugucuguaaucauugcaucucugucugagccagaaagggaguucacaccuaaggagugugaaaggccagcaugcuguuuauuugaaacaguggaacacagauagacuucagccgguuuaggauuuuggaagaggcugagguuuucaaacuuuguggcucuguacuagagauguaacugauguuaucugaggugucucuaggagcucugaacaugccauguggaauugugucucauaccauguuccucgggucaguuuucuauuuuaauaauaaaaggaaagaacuuucaaagcccugauugaugagcuauaugacaacuuuuuguaauaaaaguaguaauagaauauuuuugguuaaauuguauuguuucuaaggauaguaagccuuguucuguugcacuagggaccaguguuuaugauccauggguauuucugauugauuuuuuuuuuuccuguuuugagaaauggucuugcuguguggcccagccuauccuugaacuuguagagauguuuuugccuuuaccugaguacuggcauuccaggugugcuccaccauaccagacccucaaugaucuuuuaaugagaacugaggcugagaguagaaaacauuguuaggucaauaagguuagucuggagaaaguauaaagcguuguuuuuguggagggaggauuuuccuguccuuucuugcuccuaggcaggugacuuuguaucuuuagagcugcgccuuuuagaaaaauuaacaacagacagcccacaggacagugguaaggaccguugcagugaucuguaugaaguacacauagacacucaauauauacucaccacuguucuuauuuuugacuugcuacuguagugcucauaauuuaaaaaauaguacuucaguauaauuggccuuagccuuccuuauucucugaaaagcacucuccccacucccuacuucuaccccagucacuguguggagaacauuuucuaggcugccucugcuuuaaccagcaggcaaacugacccuauagucccgaccacccauuuucggcuaugcugccuuucugaauuugucauacuuuagagcaaaggagcaaguaaccugucuuugaaagaugauuagaaucaagaaaguuaauuucuaucuucaaugaauuuacaaacauguguuguuacuuuaaauuuagaaaauaaauguaauuaauuacauaauagaagaggguuuucacauugcuuaaauucuuuguugaguaagcuagugaaauuacaaaugaacugauuucaugagcuagaauguagggauuuaaaguacagaaagaucuuugaugauuuuucuuacaguaagaaaaugaaacuaguagguaugguggugcaugucuaaaaucucaguauuuaggaguuaggagcagggaaauuaaaaguucaagccuauccuuaacuaaacaguaaguuugaggcuagcaugaauugcauaaaaggcugcuucaaaaaaguaaagccuaguguagaagagagcugauaagguuuaauagggguauacagaaguguggguaggaacaggagucaggauugagucucuauguauucaacauagacucaguaccccugcugaaaagcagacucugaauugaggccaguaugaagaagcuauaaaguucuggaggaccaucucugcacugacagcaacauuagccuugggacaagaaagacaaugauacagaauuagguuaaaagugcaguugcagcuugacaaccugaaagcauuuauguugaguuauuaugggcagugucugcaguugacuucuuucuuuuaaagucgcugauuggcuggaggaauguaacacgacugcugguguuuuccacggaugcuggguuucacuuugcuggagaugggaaacuuggugguauuguuuuacccaaugauggacaaugucaccuggaaaauaauguauauacaaugagccauuacuauguaaguacuuaggccugccuagugagugaguuuuggugauuuuaguguaauccugagcaugugggagggcaggguuugcagcuuucuuguuuugguuagugugggcccugaugauggcugggaaagcugcauugcugcuuguaaagcucuuggcaaugugcuauucugucuggguggugggaaugcugagauccaucugguuccucacuugaauacaucauuugucagucuugcuggucauauuucuaaaugugcaauuuuuaacuaggcuuacccucuauaucuuaugacuuaaaaauacacacucuggcuuucauugaaagcaaauauaggcaaaucacucagguucuagaagaaaucuaguauuggugaaucuuagucuuaagugcuagauaaugggaaccuuuaguucugguuccuuaauuucacaguccucacauuuaaaguacauagauugucuugcuuuugaaaccucuuaaaaugggacuggagagauguucaguaguuaagagcacuuggcaacucuuccagaggaccuggguucaauucccagcagccacauggauguucacaccuuucuguaacuaucuaguuccaggguuucagauacucucacacagauauacaugcagacaaaauaccaaugaauauaaaaauaaauuauuaaaaaaugccuuaaaaaauagaaguucuuaaacauagaaaagagagacacgugacccagcuuagcacuuauuugcauuugauauucuuucuugaaagcagucugugugagugcucugauuaugaaugcuuauugacucaaauacuguacucuuagcaauugagaguaaaccuggacuauagagugagacccaaacaaaauaaacaaagccucaucauugauugcaauguauuuauauacuaaauuguauuacuuuauuccuuaggauuauccuucaauugcucaccuuguucagaaacuaagugaaaauaauauucagacgauuuuugcaguuacugaagaguuccaaccuguuuacaagguaauacaaagaaugaaaguucuauauuuuuccuauuguuuagucauuaguagcugaauuauauuuuuggaauguaagaaaaugccacaaggcauuauguucaguagcuagacugaauuugacaaccgucauuuauguucauuuuaguuguguauuauuaggauuguuauuuuaaguuugccuuugaaagauacuuaggaaaugaggugucaaaauacuacuuuucaguggauuuuaauugguugaaaaaguaauauuuauguuuuacauauuuaauuucaggaauugaagaauuugauuccuaagucagcagugggcacacugucuggaaacucuaguaaugugauccagcuaaucaucgaugccuacaacgugagugcuuuaaaugcugucagcuucaugucaugccuuaaauaaaacacccuuuauacaccucagcaagcugaagaaacuaugcaaaacgugaauuuaaauuccauggcuggaggaaaacuugauaucauuauaaucuuugaaagcacaguguaagcagagcagugguauuuagauaaaggcaugugcauaauuuccaaacuuguuuaugugucauuaggccacauaucuccucguuggaacacaacugacauuuugauguauacagguuuuauuuuaucuucuuuuucuucccuaaagccacuuuuaucgauccaucuuuuuaaguuuuauuuauuuuuucuuuuggagauuuuuuuuuuuuauguugcccugacagucuuggaauucacuauguagaccaagcuggcuuugaaugcacagagaucuaccugcgucugccucucaagugcugggaugaaagcuuugcaucuggcuagcuuucaucauuuugaugaaugaugccugacauuucuuacuuuucucguuuuucgcaagagacucagaggacacacuuuucuguuuuuaguaguaguuacacacugucaugaauguacauacauagguauaucauucaggaacugaaacuacaucagaauuuccugcagaaugcaugugauguuucccaguaagcaccagcccagucaucauuuaaaaugacccacaggcacuuacaauuucauggagucuguuaugcauuauauacaccauuuccuauauauuugguagguuaauuuagauuaaaaacuauuuuuuuaagagagagagagaaagagagaguguauguguuuguguauuauaagacaacuugugggaguuaguucucucuuaccauauggauuugggaucaaacucagguuaugaggcuugguggcaaguuuguuuuacacucugauccauccugcuagcccuagaauuuuuugagacgguaucauaugacccaggcugcccugacuucuuaguauuuccgaggaucggauccugucauguuuuugucuccaccacccagguaugcuaugucaugcuuggcuuugaacuucacauugauuucuacacaugcuuaagguuccaagacauuuuggaaagauuaugacuuagagggguuaaagacaagauucuacuucuuuuccauccucccauuccagccucucuuggcagauuguuuuccucacugcuauuccauaggggcguugucuuagugagaguuuccauugcugugaagagacaccaugaccaaggcaaacuuuuacaaaggacaacauuuaauuggugcugguuuacacuuucagagguucaguccauuaucagcauggcaggaagcauggcagugugcagguagucauggugcuggaggagcugagaguucugcaucuugaucugacugcagcuaagagaggaaggucuuuucugcauaggauugagccugagcauaggauuucaaaaccugccuacacagugacauacuucuccaacaaggccacaccucuuaauagugccauuucccaugagccaagcuuauucaaaccaccacagaugugaaugacgagagauggcuuauacuuacuaccucacuguccugagaugucugcucuuuuaaauaagcacugccugaacucuuccuugucaguuuuccccauauuuuauuuuuuauuggugcugagaaaagcugaggaccucauggcuucuagauaguguuguaccauugaguuaagcuccaguucuuuaggcucuagaaggguugggaagugagcaagaugacaguggucccaaguaaauuaguguacucuguugcuguggucucuggccagaaggaaggaggccagaggauaguuuuuggaguuguugugacacugggagcaacaaauaucuguucuguguucuuaggauuccucauaaucaggccuuuguguugugagaucauuagcauuuuagcugauuaauaaaaaguaaaugcuuucauauuguauacauuauuuugaggauuggaccuuuuuuagaguugguuauucuagguuuuuuuuuuaguuguauugaauugcauugaaaugauaguggguuuuuuuuuuuuuugagacaggguuucucuguguagcccucgcuggccucgaacucagaaaucuacaugccucugccucccaagugcugggauuaaaggcgugcaucaccacugcucugcaauaguguuuuaauaacaucuccuuucauccauuguugugugaguguauccaagucguauuuuauuuuacuucccuguucaugguuaguuuuucuuuuuuagucucuuucuucagaagucauucuggaaaauagcaaauugccagacggaguaacaauaaauuacaaauccuauugcaagaauggggugaaugggacaggagaaaauggacgaaaguguuccaacauuucuauuggagaugagguauguuguaugaccguuuucugugaaaaagaaaaacaugcauaaaaauguggggcuggagagauggcuuagcaguuaaagcacuagcauuugaaauauuuucauguucauugcuaaauuuauuaaucuuuuuuccuuuaagguucaauuugaaauuagcauaacugcuaauaaauguccaaauaaggagucugaaaccauuaaaauuaaaccucugggcuucacugaagaaguagaggucguucuucaguucaucuguaagugcaauugucaaagccauggcaucccagccagucccaagugccaugagggaaaugggacauuugaguguggagccugcagguaagugcagccuugcugcagcacaacagacaguauaggccacuuuaucugggaagccuguauaaaauaaagacacaaauccuuugcuccagucacucauauacucuuaaggaucucucuguucuuaagcuuuuagcuagguaagcaguguguccacugucucucagggcagcauuugggcuuuguucucugaauggcacuuccaguucuugacagcaaaauacauugaaaagaaaagguagauagaaacauuuuuguacaaacugucaauggugacuguauuagucaggguuuuacugcugugaauagacaccaugaccaaggcaagucuuauaaaaacaacauuuaauuggggcuggcuuacagguucagucagaaguucuguccauuaucaucaaggugagagcauggcaguaucccggcaggcauggcgcaggaggagcugagaguucuaugucuucauccaaaggcuucuaguggaagacugacuuccaggcaacuggggugaggaucuuauauccacacccacagcgacacacccauuccaaccaggucacaccuauuccaacaaggccacaccuucagauggugccacucccugguccaaggauauacaaaccaucacagugacuuuuuaaauuuuguuuuauuuuggaugacccuaaauuuaugaucuuacugucucaguacuuggguuauaggcagaacucaauacucucaguguuaaaugacaguuuuaucugugacuuaguuaacaagaaaaauguuuaccauguccaggauuaaauuuuguauuucugggauaaaaauaaaauaguacuuaaaguuuacauuuauguauguauguauguauguauguauguauauguguguaugugaguguguguguauacccuagugucuuggcacaggcuuguggugagaacaguuguaagaguugguucucugucuaccuugugaauccuaagguugucagguuuggugacaaguaccuuuaccuucaccagacuucuuggcuacuuuuuauguuaaaaacuaaacuguguuuguaauacagccuuuucuuuaaaguaauagaaccuuuuaaucuaaaugucagucucacaucacagugguuuuguuuauuggcccaaagaaaaaugaauagcuaauguuuacuauuaauugcccauuuuaagcaaugauuuaaauauuguguuuuuucuguuauauuuaacuugagacauuaagauaucuuuuuguuuaaacagcauuuuaucaaaaaggauuuuuuaaaaauucuuugucuucuuuuugauuagcauaugcaaaaucaguuuauccaguguccaagaacaugcuccaagauauguaggauauuuuagaagucuagaucugugcaguaaacuuacccuuaguuaaagcuaguacuauuuucaguuuguguacuuuauguauuuuucaacuuuugggguugcauucauugcuauuuuuuauccuaacagacccuugcuucaaauuuaguggcagguagucuguaacaauaauauaauugaaaauauuugagaaucuagcccugcaaauugauacauuccuuuauuccccugcauuugggaacuagaggcaggcagacucuguggucaaaguuagccuggucuauuuuucuauuuuucuaguuguuuuguuguuuguugcuggaguaugcuuucauuuugcucagagugguuccuugcuaaagguaaauuuuccccaaggcuccuguauguucuauaagaacuugaguugcuacuugcauguguguauauauaaacacaguggacuuaucuuauguuuguacauguggagugagcaucccuacuugauacuuugcuaaugugaggaaauuguuacacuuuuuguuuuaugugacuguguuuggaucuuucugcaggugcaaugaggggcguguugggaggcacugugaauguagcacagaugaagugaacagugaagacauggacgcuuacugcaggaaagagaacaguucggaaaucugcaguaacaauggagaaugugucuguggacaguguguguguaggaagagagauaauacaaaugaaauuuacucuggaaaauucugcgagugugauaacuucaacugugauaggucuaauggcuuaauuuguggagguggguaagcaccagcaguagcuacacacauaguuccucuaaugagaucagauaucugagagucucuggguuaacacacagaaggggaggggcuuucuucuauguuguggcuuguuuuuaauuugugaauaauugcugugauuauacauuuuaccauuguuuugagaaaugaucuuuuucguugcaggcaauggcgugugcaggugucguguuugugaaugcuaucccaauuacacuggcagugcaugugacuguucuuuggacacugguccaugucuagcgucaaauggucagaucugcaauggccgggguauuugugaauguggugcuuguaagugcacagaucccaaguuucaagggccaacuugugagacaugucagaccugccuuggcgucugugcagagcauaaguaaguacugccaaaguguuucacauagucacauucacuuuacugacccuacaccacuagagccagaggagagugcugauagaguauacuucaaagagaauauuugcugccuuuuauguaccauuuuuuauguccuaaaaauucuuaauuguguaacaaugaagugugccaugagaguuguacuauuuuuuuuguuguuguuuguuuuuaaucugaaaucacuguauaaguuugcuguuaguuggcaauacuauccucuguuuuuaagguuuagugguagagauaaaacaaugaacucuaccauagaggaauauucucuagucuaguugcuaucuuuugcuucaggagaauggaaggugaauuauuauaccaauacugcuuaaguuauugugguuuuuauguuacaaauuuaaugugacauagguccaguuuuauuaacuacaucuuaauuuuguguugugaagauuuauaugcauacaugugaauguauguaugugugugugggcuaucaccaagggcuuagaguagauuuuaauauaugucccccacgucugcaaugugcuacuuguuggucuuagacauaccuguuagagguuugucauggacaugcuggugucuuuacaaaaaggauucacaguguaggccuaauuggcaucuguguagcaaccauagcugugcucuggaugccagggucuguacuggaugcugagcagguccccauagcugacuaggaaguaagguuugugaauccgauguugggugaacucuucuugauaaggcuugguguuacuaggccccauagucacuggccuuuacugaagcuccuuauuccuccaguggagggcacaugcuucaggcagcuucuguagccagaggcuuccugggugcuuugcuacugccaguggacuuaguccaaggugggucuggagaauuuauuaccuaccccuuuauucuuugacagguuugccagccagaguguugcuggccuuaguggccguggcuuggcugaggcugcuggaaaccaggaucucauguggagcauaaugccuauuuccucugaauguauauugcccuuagauugguauggccauuaguuuagcacaugaaguauucuaagcaaaguuaaucuuaauacacgcuaaguguaacaauuucugucuuagagaauguguucagugcagagccuucaauaaaggagaaaagaaagacacgugugcacaggagugcucccacuucaaucucaccaaaguagaaagcagggagaaguugccccagccggugcaggucgauccugugacccauugcaaggagaaggacauugaugacugcugguucuauuucaccuauucagugaauggcaacaaugaagcuaucgugcauguuguggagacuccagguagaagucagaggaugccuagcauuguuucuuaugaugccuugcuuuuauucugagucauugcugggguucugguggcagaaacagccuguauucuuaucuuacuauuuauauuagguuuauauugggauauuuucuucucaaagcuuaaaguagaauuuggcuaauuauauaacaacuaaggaaggaaucaaguuuauguaaauggaacccaugcuauacuguuggugcuauuuaaaucugagcuugauccagcuuuaggagccggaagaagauauccuaaagauauuauuaauguugaauuuguucaacuucccggaaacuaagcacauuucaccuuuguuuuccuaguagccuuccuugucacucugucagguuucugguauggacacauuuuagaggaugugguaaacgucuguucaguguuacaggaaaugcuccaacuuuuacuucuuuuuacaaaugcuuuuaguguuugaaaaaagagaggacaacuuuguggaauuguuucucuuuugcuggauggguuccugagcaucagacacauguggucagucuuguuagcaagugccuuuacccacugagcccucuuguggucucugcauuguucugcagcaccagacaggagcacugugaauacuguuguaugugccucuguguuuuuccauugccuuagcaauuuuugaacacaggggcuuuauugcuguuuuugugguggugugcagugaacccaggguguugcaauaguggcuuccugauuuauuucuacaguguuaaugaugagacuuugauugacauggcaauagauuacagauuaaauuggggaaaaugcaucuugauaaaauacugucuuuuuaaaaauuaauuuaguaugugggcagaggguuaggguuaggguuagaggguuuuuuucaugugccauggauuucuccaauuaccccagucauuuuuauuugcuugaggacagucuuaccauguagcccuuggccagucuggaacuaacaaccuacauuaggcuacuucgaaguuguggcaaucuugcagccucugccacuugaaugcuaaccuauacuaccaugucuggcugccaaucaucuuuacuacugucuuuuaucauuacuuaguacuuuauaaucuugaaaaaauauuuuaauuauauauaagcuuuucauuauuuuugaugcuguuacgauuuuuuuuuaacauuuuucagucuuuagcuaaagaaauagauuuuaugacccccaaauaaaugaccugcugaucauauuuucuacugucuucuaagcucccuuguuagagccuaguagcuucuuuuuguuugagacagggucuuaccuugucuggucuggaacucacuuuguagaucaggcugaccucaaacuccuagaacuccauuuugagauuaaagguaugugccaccacaccuagccuggaacuuaguagcuuuuaaauagguuuuugggacagugcagucucuugaguguucagcacuauuaauuuuguaagaucccauccaacucuuuguggucaugugaacuuuguauauacucagucuuuuuaugcucacgauuaaccuuuucauuuguagacuguccuacuggucccgacaucaucccaauuguagcaggcgugguugcuggaauuguucuuauuggccuugccuugcugcugauuuggaaacuuuuaaugauaauucaugacagaagggaauuugcuaaauuugaaaaggagaaaaugaaugccaagugggacacgguaaguuaugaaacauuacugagagcaguaggaugguuccugaaguaaauguaacuuauuaauggugaggcugaccuuuaaagucuucuuuaaauauuuuauuucccccaaaguucaaaauccaaagaaguugcauuugcugaaaacaagaaaccuccuauucaauuaauaauuuaggaggauaugauacucuguauauauaguggccauuguguuuuaguucuuuaguaggucagauucuaaguaugcuccucagcucauuugucuaauauaaaagagaaucuuaaaugauaccaccagugucucuggccacacuagagcuccucuuccccuccauacacucaugauucuuuucauaugguuucuggaauauacaaccaaauuguuauuucuaaggcuagacugaggggagggcugacuagaaggugggauuacaacaggccuucuuagaugauuucuagguguguuugcacauuuggaaauacucagccugagcuuaauguauauuuuacucucuucagauugcaucucuguaaaaacuugcuuaauagaaaaacaggcuuugacugguaugugcugaucacugguuucagaauagagucagguaguuggauaaauguugccucuuauagauuuacauuuugacacacuacaguuagguuguuuuuuguuuuguuuuguuuuguuuugaaauuucagaaguauagaaauagaauuccaguuuauagugucaauacacuauacauuccaauuuucuuucugaugaaaucacuagaaacuauuucuuucacuuuagcaagaaaauccgauuuacaagaguccuauuaauaauuucaagaauccaaacuauggacguaaagcuggucucugaguuuccguucguauuucuuuucacuuucuauccuugcaugugaauuucugucucucuuuuuuuuuacugcaccaugugugugucucaacaccacugcuuuuuuuucuuuuuuggguuuggcuuuauuuuuauggcuauguguggcuuuucucauauguuaacuuagugcuuggaaggacuuuaccauauaauaagguauagaagccaccccuguguuggagagaaaagaaugcuuugcagucacagagccccaaucuacccuagacuugcuuaguaaguagagcagcccugagcuuuguuaccucucugaggcuccucuuaagucuucagcagggaggauuuuaacugacagcuggcugcagucuacuaugcaaucucugaugcaguccuguucaaaggucaugguacauuauuccugaauugaacagugaaauugagugugaaaucaaaauggcaaaaccaaggguaaaugacuguuguguaguuuguacugucacaguuacaauucauuuuacccauucuagaaagauucugaaaguuuuuucguucuugauuaugugggaauuccauuccacugagaaacagaguaccauuguguuucuuacuaguucugauuuucaaguuuaaaacugaaaacugcuuauuuuuauuauuaucuuucaaacaauucuuauuauuuauuuauuuauuuuugcuugagagaaagucuuacuauguagcccaggcuaucuuggauuuugcuguguacacuaggcuagccuugaccucacagacauuuuugccucucuuaaaacucccauaaaaaggcugauuacauuuagcaccaaauuauuuucuauggauuggaagagccugggagaauuccuguuuucuuaucuccauuuucugucaacagagacaauguuggcaauagcuacagagucccguguuuuaggaaugguucuuaauauccuauauuuuuuguuauuugcgagaauaauggggacuauauucuuguuuuauagaagagaagacugaggcagaaaaacagcuaguuaguaaaaagagauuuaaguucagacuaugggauuccaacacuuaugucccuauccucugcccuggacccauuagcagguuagcaaucacauucuuuaggagaggguuaccuggucaggaagaaauagaacacuuuacagaucuggccauuuucauaguguugugauuugggguaaugcuauuguguagagaaaaucucuuacacacuguguggaagcaucaccugucaauaaaaagcuguuugcaugaagcaggaaauagaagguaggauauuugggagggagagggagagggagagagaggcuucugggaaagagccaagagcaggaaauucacccugaacucugaggaagucagaucuaugaaacugagaagaaaccagacacauagcugaacucagauuagaauaaauggguuauauaaguuaugagcuaauugaggaauaagcccaagcuuauagcccuauuuauaaauaagucuuagagucauauuucuagguacaaacaccuagggagaaaaguuccuggcuucccugcugggcaaacauaaugggagaaucacuuuucuacuacacagaacucagcacugcuguuaugcuuacuuauucuguauugaccuuggaaagccaaauugaagggcuacaggauguauaaucacuuaagcagugaaucagucaauuaaaaugaaagacuugcagaaaaccccaaaucagggaguguuguauauuuuuaagggacacaggaagcagcagcaguacuagaaaucaugacucgcuguaucucuuuuacugcuaagaaacuuuuauuuaaggcuaguuuguugguagaaaguuauuguuaaaucgugugugugaaacuugaugcauucuuucacucuuaccugauacuuuacagaacuuaauuuuuauagaaaagcugauuagcuagugagauuacugugauuuuauuuauuuauuaucuuuguggucacaaucagguauuaacaguuucauauaguuacuucucacagaagaauuuucacuuuuuuuuccugugguaaauuauuugcccuuccuuuaaugacacuuugaguaauauuaaucaauaguuacuauuuaauacuaaauguuuguauucuugauuuaauuuuuggcuaucaggguuaggguuaccuucuuuagcuagaauaaacauuucauacaauuaaaaaagcaaggguuucuuaaaauuuauuuauguauuauugaaaucuaagaaaauuuauggcuauagauuaucccaagauguuaucuuaugaauauuauaguagaaaugaacaauacaaaugaaugagaguaaaacuaucagaaaaaaaaucauauaaaaacauuuuuuugugauaagggaccaaaacuucuuaccaauuaauuacaccauuagcagacacuguaauuaugugagcauauaagacugccauguugggacacugacaaaauucucaggucugcccuucccugcugugaacuacaaaccucccaguuuucauugcauaucucacauaccucacauauauaaguacacauacauaaguaauuuacagccaccacuaucagcugcucauaguagacaaagagggacucaccccaaaggauagccuacacuuuagaugcaaauaugcuuuggcuucuuggggcaggggcuguaccgagugauggaacuaaucugaauuacuuuagccuaccuacuuuuaaacugauaccuaaugcauauuauagugaguuuaucucuaacuugcauguuaaauuuuuguuugauuguacuuugacauagugaauauaaauguuaguauguauggcaaaccaaacuuauccaaagguaaguguuuuccauauaaauucugcuuuagacuccaugauaauaaauccugaacuucucuccuuuuauauuuugcuuuauguuuuguucccuuauuauucuuaagcaguaaauacuagauuuuguuaaaugcuuuaacuuaaagacaguuaaauaguaguuuaguagccuaauauauuugaaaacaggcaguucuagcaucacacccaggaaguuggaaaccucuuaccugaaugaaugcuguaugaaugaaugcugaaugaaggaugcuguaaaccccaaacagccagcaagcugggaucuugagauugugagcaguuuuguugucaguguaauagaauguuuguugaugaaucuuguaucacuuacuuuuuccauuggucuaacgagaaaagauuuacucagguucacaauuagaggguacagucugccauaguggaauaguuaacagcagguggagcuuggggcuccugaucaaaucaaagugacagaugauggggcucagcucacuuucuccuuuuauacaguauucaagcucaggaaaugauucuacucauagugggcauccugccuuaaguaacguaauccagacaugccagagacuggucccccaguuugcaucauguuguuuuaucauaauacuugugauaaacaugguugugauaaacaccaugacuuaaaagcaacuugaagaaaugaaaggguuuauuugguuuacugguaucaucagaggaaacuaaagcaggaacaugggguaggcaccuggaggccuccagagaaguucuuacugcuguguaguaacauacuuuuccugacauacucagcugccuuuugaauacaucccaggccuaccugcccagggguggcaccacauacaguggggcuggauucuccuaacuaauuaacaaucaagaaaaugcccacaggccaguauuguuggagacaaucuuuuaauuaagauccccucuuccaaggagaccuuaguuugugucaagaugacagaaacuaaccagcauuccaccacagacccuuugugcgcagaaaaguuauguuugaggaguggaagugagugaucaggugugcggucuuguucugacugguauuuacaaagcugcugccaucuugguagaugcccucucugccuuccucuagucucugcuccauucccaguaccucagaauauauuuuucaauuucaaaugaaguggauguaucucuacaucuggcauucuuuguauuuguuuuuuuaguaauuucuauguagucaguuucccuauggaaguauucuuaaacuucucauguuaauaacccuaacccuuuuucuaguacucuuuauauuauguauauaauucuaaucugaacucucagauuaccuuauuucauaucccuccauacuauacucucuucaagggcaaaauuaugauuauauaauuaugauagcuguuguucugauuaaaauacuguaguauauuuuucaauccugagaaauguuuguugugguuucgaguccguugcugaauuugcagcuguucucacucaaggaguagaacugugauuaacauuacccuuagguuauugaagaauaacaauuucaugaagcaugguuauuaguuaacauuguaagcauauuuuuggauugugacuugaugggcagagugccuugggugacacuggcagacauauccagaaaucaguucuauagagguuucaggagcacaucuccuucccuggauggaagccagccacccuauaauaaguauuucuaagcauuagaguguauaaguuagguuuuuaggguuuccauaaguugguacaagaucuucagagacucuaauggcagcuguaaagguucuguguggaggccuuuugugagguagcccucuagggaugacggacuggagucagagcacaauauuuuaauagccugagacuuuugggucagagcuggccuucucaccacugugucggauuuuaucuuugccuucuaaacucuauuugacacuggauauuggaagagacuuauuaagacaacugcagcuauuaaucuuguuuuggaacacugauuuuagagaguaacuggcaauuuguguuuuuuuuagggugaaaauccuauuuacaagagugccgugacaacuguggucaauccgaaguaugagggaaaaugaauccuacucaggcggauuuugcaacaccaagcucacagcagcagcaucuuagucacaguaggguaguuuuggggcucuguggccaggguuuuauucacaugcagguuuggaaaauguacaauauguauaauuuuuaauuuuuuauuauuuugaaaauaauguuauaauccaugccagggacugacagaagacuugagaaaggaucuuuauccuugucagcugaggucacagugugccuuuuuaacccuuccuucuggaccauuggaaucaagcucucacuagauugaaugacacugcuagugccaaugcagggcagagcugagcagcgucgcagcaucugaaccaugacugauuuucagcuucacaggguggccagggcugguuauacagaaucaaagaacaguccuugcugguggcuuuguucuuuguuuagccugcuggcugcccucugggaauucccagugauguauguggaagacaagaguguugacaguuuccaauuaaaauaaaauugacacaguugauguucaaguccauuggaaaaauucugagaggugggaaggaaaucuuagcuuuaaaaccugugugccauugugaguuacuugauccuguaacuccgacgccuuuucuuuauaaauccaaccuuggauaaaaguacugggaacuucucugcuaaaaagucccugacuuagcacuauucacauaaaggccauaauuuuaguagcauugcugaguggggaccuuuuggguugagcuuauuuuaccuuuuuuuuuuucuuuaauuccuggugcuccuuuaucaccuucucuaaucuuuuaaugugucuguuugcaauauggggguuagacuuuuuaucauuaccuuuucuuuuccuuggcuguacauuuaccuuuuucacaaauacuguaagcuguccugcugcuugcaggacuacagggccugggcagggccccccagcaacaauucacccacagugcaccugcacaugccuuuccuacaugcuugcucugucucgaacuagucacaaucuuguuuuaagugccuuuucauuuugacagugcuauuaacugaaguuauuuauuaaaauaaaaaggccuaaauacauuaa

SEQ ID NO: 12157 - RNA, 47418 nt, Mus musculus
uuaauguauuuaggccuuuuuauuuuaauaaauaacuucaguuaauagcacugucaaaaugaaaaggcacuuaaaacaagauugugacuaguucgagacagagcaagcauguaggaaaggcaugugcaggugcacugugggugaauuguugcuggggggcccugcccaggcccuguaguccugcaagcagcaggacagcuuacaguauuugugaaaaagguaaauguacagccaaggaaaagaaaagguaaugauaaaaagucuaacccccauauugcaaacagacacauuaaaagauuagagaaggugauaaaggagcaccaggaauuaaagaaaaaaaaaaagguaaaauaagcucaacccaaaagguccccacucagcaaugcuacuaaaauuauggccuuuaugugaauagugcuaagucagggacuuuuuagcagagaaguucccaguacuuuuauccaagguuggauuuauaaagaaaaggcgucggaguuacaggaucaaguaacucacaauggcacacagguuuuaaagcuaagauuuccuucccaccucucagaauuuuuccaauggacuugaacaucaacugugucaauuuuauuuuaauuggaaacugucaacacucuugucuuccacauacaucacugggaauucccagagggcagccagcaggcuaaacaaagaacaaagccaccagcaaggacuguucuuugauucuguauaaccagcccuggccacccugugaagcugaaaaucagucaugguucagaugcugcgacgcugcucagcucugcccugcauuggcacuagcagugucauucaaucuagugagagcuugauuccaaugguccagaaggaaggguuaaaaaggcacacugugaccucagcugacaaggauaaagauccuuucucaagucuucugucagucccuggcauggauuauaacauuauuuucaaaauaauaaaaaauuaaaaauuauacauauuguacauuuuccaaaccugcaugugaauaaaacccuggccacagagccccaaaacuacccuacugugacuaagaugcugcugcugugagcuugguguugcaaaauccgccugaguaggauucauuuucccucauacuucggauugaccacaguugucacggcacucuuguaaauaggauuuucacccuaaaaaaaacacaaauugccaguuacucucuaaaaucaguguuccaaaacaagauuaauagcugcaguugucuuaauaagucucuuccaauauccagugucaaauagaguuuagaaggcaaagauaaaauccgacacaguggugagaaggccagcucugacccaaaagucucaggcuauuaaaauauugugcucugacuccaguccgucaucccuagagggcuaccucacaaaaggccuccacacagaaccuuuacagcugccauuagagucucugaagaucuuguaccaacuuauggaaacccuaaaaaccuaacuuauacacucuaaugcuuagaaauacuuauuauaggguggcuggcuuccauccagggaaggagaugugcuccugaaaccucuauagaacugauuucuggauaugucugccagugucacccaaggcacucugcccaucaagucacaauccaaaaauaugcuuacaauguuaacuaauaaccaugcuucaugaaauuguuauucuucaauaaccuaaggguaauguuaaucacaguucuacuccuugagugagaacagcugcaaauucagcaacggacucgaaaccacaacaaacauuucucaggauugaaaaauauacuacaguauuuuaaucagaacaacagcuaucauaauuauauaaucauaauuuugcccuugaagagaguauaguauggagggauaugaaauaagguaaucugagaguucagauuagaauuauauacauaauauaaagaguacuagaaaaaggguuaggguuauuaacaugagaaguuuaagaauacuuccauagggaaacugacuacauagaaauuacuaaaaaaacaaauacaaagaaugccagauguagagauacauccacuucauuugaaauugaaaaauauauucugagguacugggaauggagcagagacuagaggaaggcagagagggcaucuaccaagauggcagcagcuuuguaaauaccagucagaacaagaccgcacaccugaucacucacuuccacuccucaaacauaacuuuucugcgcacaaagggucugugguggaaugcugguuaguuucugucaucuugacacaaacuaaggucuccuuggaagaggggaucuuaauuaaaagauugucuccaacaauacuggccugugggcauuuucuugauuguuaauuaguuaggagaauccagccccacuguauguggugccaccccugggcagguaggccugggauguauucaaaaggcagcugaguaugucaggaaaaguauguuacuacacagcaguaagaacuucucuggaggccuccaggugccuaccccauguuccugcuuuaguuuccucugaugauaccaguaaaccaaauaaacccuuucauuucuucaaguugcuuuuaagucaugguguuuaucacaaccauguuuaucacaaguauuaugauaaaacaacaugaugcaaacugggggaccagucucuggcaugucuggauuacguuacuuaaggcaggaugcccacuaugaguagaaucauuuccugagcuugaauacuguauaaaaggagaaagugagcugagccccaucaucugucacuuugauuugaucaggagccccaagcuccaccugcuguuaacuauuccacuauggcagacuguacccucuaauugugaaccugaguaaaucuuuucucguuagaccaauggaaaaaguaagugauacaagauucaucaacaaacauucuauuacacugacaacaaaacugcucacaaucucaagaucccagcuugcuggcuguuugggguuuacagcauccuucauucagcauucauucauacagcauucauucagguaagagguuuccaacuuccugggugugaugcuagaacugccuguuuucaaauauauuaggcuacuaaacuacuauuuaacugucuuuaaguuaaagcauuuaacaaaaucuaguauuuacugcuuaagaauaauaagggaacaaaacauaaagcaaaauauaaaaggagagaaguucaggauuuauuaucauggagucuaaagcagaauuuauauggaaaacacuuaccuuuggauaaguuugguuugccauacauacuaacauuuauauucacuaugucaaaguacaaucaaacaaaaauuuaacaugcaaguuagagauaaacucacuauaauaugcauuagguaucaguuuaaaaguagguaggcuaaaguaauucagauuaguuccaucacucgguacagccccugccccaagaagccaaagcauauuugcaucuaaaguguaggcuauccuuuggggugagucccucuuugucuacuaugagcagcugauagugguggcuguaaauuacuuauguauguguacuuauauaugugagguaugugagauaugcaaugaaaacugggagguuuguaguucacagcagggaagggcagaccugagaauuuugucagugucccaacauggcagucuuauaugcucacauaauuacagugucugcuaaugguguaauuaauugguaagaaguuuuggucccuuaucacaaaaaaauguuuuuauaugauuuuuuuucugauaguuuuacucucauucauuuguauuguucauuucuacuauaauauucauaagauaacaucuugggauaaucuauagccauaaauuuucuuagauuucaauaauacauaaauaaauuuuaagaaacccuugcuuuuuuaauuguaugaaauguuuauucuagcuaaagaagguaacccuaacccugauagccaaaaauuaaaucaagaauacaaacauuuaguauuaaauaguaacuauugauuaauauuacucaaagugucauuaaaggaagggcaaauaauuuaccacaggaaaaaaaagugaaaauucuucugugagaaguaacuauaugaaacuguuaauaccugauugugaccacaaagauaauaaauaaauaaaaucacaguaaucucacuagcuaaucagcuuuucuauaaaaauuaaguucuguaaaguaucagguaagagugaaagaaugcaucaaguuucacacacacgauuuaacaauaacuuucuaccaacaaacuagccuuaaauaaaaguuucuuagcaguaaaagagauacagcgagucaugauuucuaguacugcugcugcuuccugugucccuuaaaaauauacaacacucccugauuugggguuuucugcaagucuuucauuuuaauugacugauucacugcuuaagugauuauacauccuguagcccuucaauuuggcuuuccaaggucaauacagaauaaguaagcauaacagcagugcugaguucuguguaguagaaaagugauucucccauuauguuugcccagcagggaagccaggaacuuuucucccuagguguuuguaccuagaaauaugacucuaagacuuauuuauaaauagggcuauaagcuugggcuuauuccucaauuagcucauaacuuauauaacccauuuauucuaaucugaguucagcuaugugucugguuucuucucaguuucauagaucugacuuccucagaguucagggugaauuuccugcucuuggcucuuucccagaagccucucucucccucucccucucccucccaaauauccuaccuucuauuuccugcuucaugcaaacagcuuuuuauugacaggugaugcuuccacacaguguguaagagauuuucucuacacaauagcauuaccccaaaucacaacacuaugaaaauggccagaucuguaaaguguucuauuucuuccugaccagguaacccucuccuaaagaaugugauugcuaaccugcuaauggguccagggcagaggauagggacauaaguguuggaaucccauagucugaacuuaaaucucuuuuuacuaacuagcuguuuuucugccucagucuucucuucuauaaaacaagaauauaguccccauuauucucgcaaauaacaaaaaauauaggauauuaagaaccauuccuaaaacacgggacucuguagcuauugccaacauugucucuguugacagaaaauggagauaagaaaacaggaauucucccaggcucuuccaauccauagaaaauaauuuggugcuaaauguaaucagccuuuuuaugggaguuuuaagagaggcaaaaaugucugugaggucaaggcuagccuaguguacacagcaaaauccaagauagccugggcuacauaguaagacuuucucucaagcaaaaauaaauaaauaaauaauaagaauuguuugaaagauaauaauaaaaauaagcaguuuucaguuuuaaacuugaaaaucagaacuaguaagaaacacaaugguacucuguuucucaguggaauggaauucccacauaaucaagaacgaaaaaacuuucagaaucuuucuagaauggguaaaaugaauuguaacugugacaguacaaacuacacaacagucauuuacccuugguuuugccauuuugauuucacacucaauuucacuguucaauucaggaauaauguaccaugaccuuugaacaggacugcaucagagauugcauaguagacugcagccagcugucaguuaaaauccucccugcugaagacuuaagaggagccucagagagguaacaaagcucagggcugcucuacuuacuaagcaagucuaggguagauuggggcucugugacugcaaagcauucuuuucucuccaacacagggguggcuucuauaccuuauuauaugguaaaguccuuccaagcacuaaguuaacauaugagaaaagccacacauagccauaaaaauaaagccaaacccaaaaaagaaaaaaaagcagugguguugagacacacacauggugcaguaaaaaaaaagagagacagaaauucacaugcaaggauagaaagugaaaagaaauacgaacggaaacucagagaccagcuuuacguccauaguuuggauucuugaaauuauuaauaggacucuuguaaaucggauuuucuugcuaaagugaaagaaauaguuucuagugauuucaucagaaagaaaauuggaauguauaguguauugacacuauaaacuggaauucuauuucuauacuucugaaauuucaaaacaaaacaaaacaaaacaaaaaacaaccuaacuguagugugucaaaauguaaaucuauaagaggcaacauuuauccaacuaccugacucuauucugaaaccagugaucagcacauaccagucaaagccuguuuuucuauuaagcaaguuuuuacagagaugcaaucugaagagaguaaaauauacauuaagcucaggcugaguauuuccaaaugugcaaacacaccuagaaaucaucuaagaaggccuguuguaaucccaccuucuagucagcccuccccucagucuagccuuagaaauaacaauuugguuguauauuccagaaaccauaugaaaagaaucaugaguguauggaggggaagaggagcucuaguguggccagagacacuggugguaucauuuaagauucucuuuuauauuagacaaaugagcugaggagcauacuuagaaucugaccuacuaaagaacuaaaacacaauggccacuauauauacagaguaucauauccuccuaaauuauuaauugaauaggagguuucuuguuuucagcaaaugcaacuucuuuggauuuugaacuuugggggaaauaaaauauuuaaagaagacuuuaaaggucagccucaccauuaauaaguuacauuuacuucaggaaccauccuacugcucucaguaauguuucauaacuuaccgugucccacuuggcauucauuuucuccuuuucaaauuuagcaaauucccuucugucaugaauuaucauuaaaaguuuccaaaucagcagcaaggcaaggccaauaagaacaauuccagcaaccacgccugcuacaauugggaugaugucgggaccaguaggacagucuacaaaugaaaagguuaaucgugagcauaaaaagacugaguauauacaaaguucacaugaccacaaagaguuggaugggaucuuacaaaauuaauagugcugaacacucaagagacugcacugucccaaaaaccuauuuaaaagcuacuaaguuccaggcuaggugugguggcacauaccuuuaaucucaaaauggaguucuaggaguuugaggucagccugaucuacaaagugaguuccagaccagacaagguaagacccugucucaaacaaaaagaagcuacuaggcucuaacaagggagcuuagaagacaguagaaaauaugaucagcaggucauuuauuugggggucauaaaaucuauuucuuuagcuaaagacugaaaaauguuaaaaaaaaaucguaacagcaucaaaaauaaugaaaagcuuauauauaauuaaaauauuuuuucaagauuauaaaguacuaaguaaugauaaaagacaguaguaaagaugauuggcagccagacaugguaguauagguuagcauucaaguggcagaggcugcaagauugccacaacuucgaaguagccuaauguagguuguuaguuccagacuggccaagggcuacaugguaagacuguccucaagcaaauaaaaaugacugggguaauuggagaaauccauggcacaugaaaaaaacccucuaacccuaacccuaacccucugcccacauacuaaauuaauuuuuaaaaagacaguauuuuaucaagaugcauuuuccccaauuuaaucuguaaucuauugccaugucaaucaaagucucaucauuaacacuguagaaauaaaucaggaagccacuauugcaacacccuggguucacugcacaccaccacaaaaacagcaauaaagccccuguguucaaaaauugcuaaggcaauggaaaaacacagaggcacauacaacaguauucacagugcuccugucuggugcugcagaacaaugcagagaccacaagagggcucaguggguaaaggcacuugcuaacaagacugaccacaugugucugaugcucaggaacccauccagcaaaagagaaacaauuccacaaaguuguccucucuuuuuucaaacacuaaaagcauuuguaaaaagaaguaaaaguuggagcauuuccuguaacacugaacagacguuuaccacauccucuaaaauguguccauaccagaaaccugacagagugacaaggaaggcuacuaggaaaacaaaggugaaaugugcuuaguuuccgggaaguugaacaaauucaacauuaauaauaucuuuaggauaucuucuuccggcuccuaaagcuggaucaagcucagauuuaaauagcaccaacaguauagcauggguuccauuuacauaaacuugauuccuuccuuaguuguuauauaauuagccaaauucuacuuuaagcuuugagaagaaaauaucccaauauaaaccuaauauaaauaguaagauaagaauacaggcuguuucugccaccagaaccccagcaaugacucagaauaaaagcaaggcaucauaagaaacaaugcuaggcauccucugacuucuaccuggagucuccacaacaugcacgauagcuucauuguugccauucacugaauaggugaaauagaaccagcagucaucaauguccuucuccuugcaaugggucacaggaucgaccugcaccggcuggggcaacuucucccugcuuucuacuuuggugagauugaagugggagcacuccugugcacacgugucuuucuuuucuccuuuauugaaggcucugcacugaacacauucucuaagacagaaauuguuacacuuagcguguauuaagauuaacuuugcuuagaauacuucaugugcuaaacuaauggccauaccaaucuaagggcaauauacauucagaggaaauaggcauuaugcuccacaugagauccugguuuccagcagccucagccaagccacggccacuaaggccagcaacacucuggcuggcaaaccugucaaagaauaaagggguagguaauaaauucuccagacccaccuuggacuaaguccacuggcaguagcaaagcacccaggaagccucuggcuacagaagcugccugaagcaugugcccuccacuggaggaauaaggagcuucaguaaaggccagugacuauggggccuaguaacaccaagccuuaucaagaagaguucacccaacaucggauucacaaaccuuacuuccuagucagcuauggggaccugcucagcauccaguacagacccuggcauccagagcacagcuaugguugcuacacagaugccaauuaggccuacacugugaauccuuuuuguaaagacaccagcauguccaugacaaaccucuaacagguaugucuaagaccaacaaguagcacauugcagacgugggggacauauauuaaaaucuacucuaagcccuuggugauagcccacacacacauacauacauucacauguaugcauauaaaucuucacaacacaaaauuaagauguaguuaauaaaacuggaccuaugucacauuaaauuuguaacauaaaaaccacaauaacuuaagcaguauugguauaauaauucaccuuccauucuccugaagcaaaagauagcaacuagacuagagaauauuccucuaugguagaguucauuguuuuaucucuaccacuaaaccuuaaaaacagaggauaguauugccaacuaacagcaaacuuauacagugauuucagauuaaaaacaaacaacaacaaaaaaaauaguacaacucucauggcacacuucauuguuacacaauuaagaauuuuuaggacauaaaaaaugguacauaaaaggcagcaaauauucucuuugaaguauacucuaucagcacucuccucuggcucuagugguguagggucaguaaagugaaugugacuaugugaaacacuuuggcaguacuuacuuaugcucugcacagacgccaaggcaggucugacaugucucacaaguuggcccuugaaacuugggaucugugcacuuacaagcaccacauucacaaauaccccggccauugcagaucugaccauuugacgcuagacauggaccaguguccaaagaacagucacaugcacugccaguguaauugggauagcauucacaaacacgacaccugcacacgccauugccugcaacgaaaaagaucauuucucaaaacaaugguaaaauguauaaucacagcaauuauucacaaauuaaaaacaagccacaacauagaagaaagccccuccccuucuguguguuaacccagagacucucagauaucugaucucauuagaggaacuauguguguagcuacugcuggugcuuacccaccuccacaaauuaagccauuagaccuaucacaguugaaguuaucacacucgcagaauuuuccagaguaaauuucauuuguauuaucucucuuccuacacacacacuguccacagacacauucuccauuguuacugcagauuuccgaacuguucucuuuccugcaguaagcguccaugucuucacuguucacuucaucugugcuacauucacagugccucccaacacgccccucauugcaccugcagaaagauccaaacacagucacauaaaacaaaaaguguaacaauuuccucacauuagcaaaguaucaaguagggaugcucacuccacauguacaaacauaagauaaguccacuguguuuauauauacacacaugcaaguagcaacucaaguucuuauagaacauacaggagccuuggggaaaauuuaccuuuagcaaggaaccacucugagcaaaaugaaagcauacuccagcaacaaacaacaaaacaacuagaaaaauagaaaaauagaccaggcuaacuuugaccacagagucugccugccucuaguucccaaaugcaggggaauaaaggaauguaucaauuugcagggcuagauucucaaauauuuucaauuauauuauuguuacagacuaccugccacuaaauuugaagcaagggucuguuaggauaaaaaauagcaaugaaugcaaccccaaaaguugaaaaauacauaaaguacacaaacugaaaauaguacuagcuuuaacuaaggguaaguuuacugcacagaucuagacuucuaaaauauccuacauaucuuggagcauguucuuggacacuggauaaacugauuuugcauaugcuaaucaaaaagaagacaaagaauuuuuaaaaaauccuuuuugauaaaaugcuguuuaaacaaaaagauaucuuaaugucucaaguuaaauauaacagaaaaaacacaauauuuaaaucauugcuuaaaaugggcaauuaauaguaaacauuagcuauucauuuuucuuugggccaauaaacaaaaccacugugaugugagacugacauuuagauuaaaagguucuauuacuuuaaagaaaaggcuguauuacaaacacaguuuaguuuuuaacauaaaaaguagccaagaagucuggugaagguaaagguacuugucaccaaaccugacaaccuuaggauucacaagguagacagagaaccaacucuuacaacuguucucaccacaagccugugccaagacacuaggguauacacacacacucacauacacacauauacauacauacauacauacauacauacauaaauguaaacuuuaaguacuauuuuauuuuuaucccagaaauacaaaauuuaauccuggacaugguaaacauuuuucuuguuaacuaagucacagauaaaacugucauuuaacacugagaguauugaguucugccuauaacccaaguacugagacaguaagaucauaaauuuagggucauccaaaauaaaacaaaauuuaaaaagucacugugaugguuuguauauccuuggaccagggaguggcaccaucugaagguguggccuuguuggaauaggugugaccugguuggaaugggugugucgcuguggguguggauauaagauccucaccccaguugccuggaagucagucuuccacuagaagccuuuggaugaagacauagaacucucagcuccuccugcgccaugccugccgggauacugccaugcucucaccuugaugauaauggacagaacuucugacugaaccuguaagccagccccaauuaaauguuguuuuuauaagacuugccuuggucauggugucuauucacagcaguaaaacccugacuaauacagucaccauugacaguuuguacaaaaauguuucuaucuaccuuuucuuuucaauguauuuugcugucaagaacuggaagugccauucagagaacaaagcccaaaugcugcccugagagacaguggacacacugcuuaccuagcuaaaagcuuaagaacagagagauccuuaagaguauaugagugacuggagcaaaggauuugugucuuuauuuuauacaggcuucccagauaaaguggccuauacugucuguugugcugcagcaaggcugcacuuaccugcaggcuccacacucaaaugucccauuucccucauggcacuugggacuggcugggaugccauggcuuugacaauugcacuuacagaugaacugaagaacgaccucuacuucuucagugaagcccagagguuuaauuuuaaugguuucagacuccuuauuuggacauuuauuagcaguuaugcuaauuucaaauugaaccuuaaaggaaaaaagauuaauaaauuuagcaaugaacaugaaaauauuucaaaugcuagugcuuuaacugcuaagccaucucuccagccccacauuuuuaugcauguuuuucuuuuucacagaaaacggucauacaacauaccucaucuccaauagaaauguuggaacacuuucguccauuuucuccugucccauucaccccauucuugcaauaggauuuguaauuuauuguuacuccgucuggcaauuugcuauuuuccagaaugacuucugaagaaagagacuaaaaaagaaaaacuaaccaugaacagggaaguaaaauaaaauacgacuuggauacacucacacaacaauggaugaaaggagauguuauuaaaacacuauugcagagcaguggugaugcacgccuuuaaucccagcacuugggaggcagaggcauguagauuucugaguucgaggccagcgagggcuacacagagaaacccugucucaaaaaaaaaaaaaacccacuaucauuucaaugcaauucaauacaacuaaaaaaaaaaccuagaauaaccaacucuaaaaaagguccaauccucaaaauaauguauacaauaugaaagcauuuacuuuuuauuaaucagcuaaaaugcuaaugaucucacaacacaaaggccugauuaugaggaauccuaagaacacagaacagauauuuguugcucccagugucacaacaacuccaaaaacuauccucuggccuccuuccuucuggccagagaccacagcaacagaguacacuaauuuacuugggaccacugucaucuugcucacuucccaacccuucuagagccuaaagaacuggagcuuaacucaaugguacaacacuaucuagaagccaugagguccucagcuuuucucagcaccaauaaaaaauaaaauauggggaaaacugacaaggaagaguucaggcagugcuuauuuaaaagagcagacaucucaggacagugagguaguaaguauaagccaucucucgucauucacaucuguggugguuugaauaagcuuggcucaugggaaauggcacuauuaagagguguggccuuguuggagaaguaugucacuguguaggcagguuuugaaauccuaugcucaggcucaauccuaugcagaaaagaccuuccucucuuagcugcagucagaucaagaugcagaacucucagcuccuccagcaccaugacuaccugcacacugccaugcuuccugccaugcugauaauggacugaaccucugaaaguguaaaccagcaccaauuaaauguuguccuuuguaaaaguuugccuuggucauggugucucuucacagcaauggaaacucucacuaagacaacgccccuauggaauagcagugaggaaaacaaucugccaagagaggcuggaaugggaggauggaaaagaaguagaaucuugucuuuaaccccucuaagucauaaucuuuccaaaaugucuuggaaccuuaagcauguguagaaaucaaugugaaguucaaagccaagcaugacauagcauaccugggugguggagacaaaaacaugacaggauccgauccucggaaauacuaagaagucagggcagccugggucauaugauaccgucucaaaaaauucuagggcuagcaggauggaucagaguguaaaacaaacuugccaccaagccucauaaccugaguuugaucccaaauccauaugguaagagagaacuaacucccacaaguugucuuauaauacacaaacacauacacucucucuuucucucucucucuuaaaaaaauaguuuuuaaucuaaauuaaccuaccaaauauauaggaaaugguguauauaaugcauaacagacuccaugaaauuguaagugccugugggucauuuuaaaugaugacugggcuggugcuuacugggaaacaucacaugcauucugcaggaaauucugauguaguuucaguuccugaaugauauaccuauguauguacauucaugacaguguguaacuacuacuaaaaacagaaaaguguguccucugagucucuugcgaaaaacgagaaaaguaagaaaugucaggcaucauucaucaaaaugaugaaagcuagccagaugcaaagcuuucaucccagcacuugagaggcagacgcagguagaucucugugcauucaaagccagcuuggucuacauagugaauuccaagacugucagggcaacauaaaaaaaaaaaaucuccaaaagaaaaaauaaauaaaacuuaaaaagauggaucgauaaaaguggcuuuagggaagaaaaagaagauaaaauaaaaccuguauacaucaaaaugucaguuguguuccaacgaggagauauguggccuaaugacacauaaacaaguuuggaaauuaugcacaugccuuuaucuaaauaccacugcucugcuuacacugugcuuucaaagauuauaaugauaucaaguuuuccuccagccauggaauuuaaauucacguuuugcauaguuucuucagcuugcugagguguauaaaggguguuuuauuuaaggcaugacaugaagcugacagcauuuaaagcacucacguuguaggcaucgaugauuagcuggaucacauuacuagaguuuccagacagugugcccacugcugacuuaggaaucaaauucuucaauuccugaaauuaaauauguaaaacauaaauauuacuuuuucaaccaauuaaaauccacugaaaaguaguauuuugacaccucauuuccuaaguaucuuucaaaggcaaacuuaaaauaacaauccuaauaauacacaacuaaaaugaacauaaaugacgguugucaaauucagucuagcuacugaacauaaugccuuguggcauuuucuuacauuccaaaaauauaauucagcuacuaaugacuaaacaauaggaaaaauauagaacuuucauucuuuguauuaccuuguaaacagguuggaacucuucaguaacugcaaaaaucgucugaauauuauuuucacuuaguuucugaacaaggugagcaauugaaggauaauccuaaggaauaaaguaauacaauuuaguauauaaauacauugcaaucaaugaugaggcuuuguuuauuuuguuugggucucacucuauaguccagguuuacucucaauugcuaagaguacaguauuugagucaauaagcauucauaaucagagcacucacacagacugcuuucaagaaagaauaucaaaugcaaauaagugcuaagcugggucacgugucucucuuuucuauguuuaagaacuucuauuuuuuaaggcauuuuuuaauaauuuauuuuuauauucauugguauuuugucugcauguauaucugugugagaguaucugaaacccuggaacuagauaguuacagaaaggugugaacauccauguggcugcugggaauugaacccagguccucuggaagaguugccaagugcucuuaacuacugaacaucucuccagucccauuuuaagagguuucaaaagcaagacaaucuauguacuuuaaaugugaggacugugaaauuaaggaaccagaacuaaagguucccauuaucuagcacuuaagacuaagauucaccaauacuagauuucuucuagaaccugagugauuugccuauauuugcuuucaaugaaagccagaguguguauuuuuaagucauaagauauagaggguaagccuaguuaaaaauugcacauuuagaaauaugaccagcaagacugacaaaugauguauucaagugaggaaccagauggaucucagcauucccaccacccagacagaauagcacauugccaagagcuuuacaagcagcaaugcagcuuucccagccaucaucagggcccacacuaaccaaaacaagaaagcugcaaacccugcccucccacaugcucaggauuacacuaaaaucaccaaaacucacucacuaggcaggccuaaguacuuacauaguaauggcucauuguauauacauuauuuuccaggugacauuguccaucauuggguaaaacaauaccaccaaguuucccaucuccagcaaagugaaacccagcauccguggaaaacaccagcagucguguuacauuccuccagccaaucagcgacuuuaaaagaaagaagucaacugcagacacugcccauaauaacucaacauaaaugcuuucagguugucaagcugcaacugcacuuuuaaccuaauucuguaucauugucuuucuugucccaaggcuaauguugcugucagugcagagaugguccuccagaacuuuauagcuucuucauacuggccucaauucagagucugcuuuucagcagggguacugagucuauguugaauacauagagacucaauccugacuccuguuccuacccacacuucuguauaccccuauuaaaccuuaucagcucucuucuacacuaggcuuuacuuuuuugaagcagccuuuuaugcaauucaugcuagccucaaacuuacuguuuaguuaaggauaggcuugaacuuuuaauuucccugcuccuaacuccuaaauacugagauuuuagacaugcaccaccauaccuacuaguuucauuuucuuacuguaagaaaaaucaucaaagaucuuucuguacuuuaaaucccuacauucuagcucaugaaaucaguucauuuguaauuucacuagcuuacucaacaaagaauuuaagcaaugugaaaacccucuucuauuauguaauuaauuacauuuauuuucuaaauuuaaaguaacaacacauguuuguaaauucauugaagauagaaauuaacuuucuugauucuaaucaucuuucaaagacagguuacuugcuccuuugcucuaaaguaugacaaauucagaaaggcagcauagccgaaaauggguggucgggacuauagggucaguuugccugcugguuaaagcagaggcagccuagaaaauguucuccacacagugacugggguagaaguagggaguggggagagugcuuuucagagaauaaggaaggcuaaggccaauuauacugaaguacuauuuuuuaaauuaugagcacuacaguagcaagucaaaaauaagaacaguggugaguauauauugagugucuauguguacuucauacagaucacugcaacgguccuuaccacuguccugugggcugucuguuguuaauuuuucuaaaaggcgcagcucuaaagauacaaagucaccugccuaggagcaagaaaggacaggaaaauccucccuccacaaaaacaacgcuuuauacuuucuccagacuaaccuuauugaccuaacaauguuuucuacucucagccucaguucucauuaaaagaucauugagggucugguaugguggagcacaccuggaaugccaguacucagguaaaggcaaaaacaucucuacaaguucaaggauaggcugggccacacagcaagaccauuucucaaaacaggaaaaaaaaaaaucaaucagaaauacccauggaucauaaacacuggucccuagugcaacagaacaaggcuuacuauccuuagaaacaauacaauuuaaccaaaaauauucuauuacuacuuuuauuacaaaaaguugucauauagcucaucaaucagggcuuugaaaguucuuuccuuuuauuauuaaaauagaaaacugacccgaggaacaugguaugagacacaauuccacauggcauguucagagcuccuagagacaccucagauaacaucaguuacaucucuaguacagagccacaaaguuugaaaaccucagccucuuccaaaauccuaaaccggcugaagucuaucuguguuccacuguuucaaauaaacagcaugcuggccuuucacacuccuuaggugugaacucccuuucuggcucagacagagaugcaaugauuacagacacccgagaaagcagcagugggaacguaagaacugacaucagugcuccucgggguaaucuuauaguagcuaugguccuuuuguucuaacuuuuauuaaaaacacuuaaaauaaauccccacagacaaugcuaacaguccccuguagaaauaaaucacuuacuccacaaaccgcaaccugcaugauugcaucaaagccaccuucuggagaauccaaguuuccagauaugcguugcugaccaacaaguucauugaaaaacucuccucugucaguaagacuaagcacauuuuuguagcuaaaugggcuggugcaguuuuguucacuuguacaaggauuucuuagcuuugcugggguugugcuaauauacggcaucacaguuuucuccacaaaugagccaaagccuaaagaaaagaauguacuuggauagaugagugggaagagaccaacaaacuuacaucacuuuuaaauugauauuuacuuauuuauuugggugaaggaugugcacacauauaccacaaugcaugucuggaggucaaaggacaagcaggaacugauuuuggagacugagcucagucaucacacuuaaaggcaggacccuuauccccugagccaucucucaccaacucuaaaugcacaucuuuuucuaaagcccaguauggaggcugcagggacugcacugugggaagagcuccugcugcauuagcgugaggauaaguucagauccuagcagccagguaaaaggccaggcgugcacauacacaccuugcaccccagcacugcugcaggaaaagacaggaaauuauaggccacaaaccuagguaagugauaaacugugucucacagaaaugagacacaaagugauaacauaagacacucaauagccugcucugcacacaugcagaaccaccccucaacacacacacacacaaaauguucccaacauuccuaccaaugcggaagucugaaguaauccuccucauuucauucaucaaauccguuccaagacuuuucacauucuccagaucaucuuucauagaguaggagagauccauaagguaguagagaucaauaggguaaucuucagcccucuugaauuuuaauguaaacuucugugguucuccuaauuaacaagauucaaaacugaaauuagauggccaguaaucaaaauaaaaugagaaaaaaaguaaguccaauuuacauguucaaugauauagucuuaaguguauauuuuuuccaaaucuaagaauuuuguuagcgccucaacaggcacacuugauuucguuuaaccaaccauuuacaacuccaagaccuaaggaggcaaaaaugaugaaggcaaugcccucuccagcaacccacaaaauacaaauaauucugcuacaguuuggaucugcccauguguugguacuuucaggaggcagugggaaguuugagagguaaggacuagcaggagguuuggguuaccagugaugugcccuggagucuaugggaccuccuuucugucuuaucucccagaugccccaccaugacaucucacaucaccacaagcucagagcaacaggccacuccgucagaugaaaacuucuaaaacuauggcccaaaauaagcuuuucuuuuuacauguauuucaaguaguuguuacuguaaccacaaggugauuuacacaaaaacuuaugagaaaaucagaacaccaugaguuuuggcagaaugaaagguacauucuagacagguagagauuaaaguuaagagugaaauguucucuguguaaaggcacugcuacacaaaggugaguaacgaucuaguuuuacuuuagaguuguaaaaggaaguuacagaggugaagccauaauuacaaaaagaucaagaaaaaaagaugaagccuaaacugaaaaaugaggaaggcgagagagguaaaaguuguuacauguuacuuacuuaaaaagcacagagcuggaaggcagcuuagugguagagcauuugcccagcacaugagagauccuaaauucuaucuccaguaccacaaaauaaaacacaaacaugggagaaaauggaaggucugcuuagaugaaaaacgaucuuuuuucccugacuuccuggcaggcagcuggagaacagguacagagcuaaacggaaaagcuuaugucauugcugaaugaugauuuccaaugaugaugagaggaaaaccaagucuuaccuaaauuugcagaaggaugaaaggaagaaaacacaaaaaggaaauuggaagcaauggaaggaacugagaaaaaccagcagugacauggacuccuaaguuuaagaagagagccucuuacaagcuccccacaguaggaguaacgacgaggggcuagagaugacuuagaaguuaagagcacuugcugcuuuuacgaggacccagguucaacuccuaacauaugucagcucauaaccauacuucaguuccaagggaucugauaacuucugaccucugcaggcaccagguacauacacggugcacauaugcauguauucauacaggcaaaaugugcauauaaaaaauaaguaaaccuaaaaaauguuuuuaaguaaugaugauuaaaauaaaaugugacuuaggcaaauacauaaucaauguccugaucaggauccugcaggucaaagaaugauaguaguauuccacuacaguauauguacaagaagucuguacuaaguacuuuuccugacauugcaacuuaggagaaagaagauuuauuuuuggcucaguuucaagaaggucacagaaguuagagcaggaccaagagggaacagcacucuaugucuuggcaacucaggaaacuaaagcccacccccagagacacacacucugccagucaagccucagcaacugaaggcuccacagacucccaaaacagcacuacaagccaagaacaaaagucggcaugcaggaaccuaagugggacauuucacauucaaacuauaacaaugucuauuuccuaggcugaaguuuagccaggcagcaguaacaggauggaaggaugacaggcagaaagagggcauguugucuauuucagaggugggauggccaugagcacuuauaaaaucguuaguauuuaaaugguacuaaacgauguauggauuaaaacuuagcuuuucacugacugcucuuccagagguccagaguucaauucccagcaaccacaugguggcucaaaccaucuguaaugggauccaaugcccucuucugguacgucugaagucagcuacaguguacucauauacauuaaauaaauaaguaaaacuuugcuuuuauauuaugaaauuauacuaacagauggaugcucuaccacuaagcugccuuccagcucugugcuuuuuaaguaaauaacauguaacaacuuuuaccucucucgccuuccucauuuuucaguuuaggcuucaucuuuuuuuccuugaucuuuuuguaauuaugacuucaccucuguaacuuccuuuuacaacucuaaaguaaaacuagaucguuacucaccuuuguguagcagugccuuuacacagagaacauuucacucuuaacuuuaaucucuaucauuaaauuauuaaaaguaauaugucuuacaaaaauuguggccaggaaucaaaaguguggcauacaccuuuaaucccagcaucugggaagaggagacaagcagaucucugagacugaagccaaccuggucuaccgagcaaguuccaggacagcaaaaagcaacaaaaagagguuauguccucuaaaauuuaacuuaugcccuauuugggguaccaguucacccaaaugaaccaucaaaagacugggaaaaggcuuguauaaacuugcuauggaaaacucagguagggauagagguaccugaucucaauuuuagaagcagcuguugugguuggaucugaguaaugucuucuggccggagcuucucugccaucccuuugcugcgauuggugacauuuuuauuuuucuuuauaguuugagagccucugggauucucuaugucacuuggcuggcaacccuucuuuuucaaagcuucuaaaucaucacaucgugcagaaguaggcauuccuucuugcaaaaaugucuaaaugaaauauaaaauacaucaacaaaaaaaguauagcaaguauuuugauguuuuuuacugcauguaaacaaauuacaaaaaucaaaugacuuaaucuaagguaguucguuucuagcuucuuaacaaaaauccacaacgugguaugugugugcucuuacacaaaaacaaguaaaaccaacugaaaaaguccuaucuuuccccaggcuuuaugcauauuuuagaagccucaccuuucaaauucagaguaugucaauacuaacuacauccuucaguguuuggcauacuuagcagcaccuaauuauggauaagcccacacauuagacaauauuauuuucucuuagaaaaguccuuugaaggacuucccagcaaagcauuuuaaacaacuaggcguuuaagaaaaccacauuagccuaaauacaucccaauuaauaguguguguguguguguguguguguguaaagcauagcauaaacuuuccugaauaaaaacuuuuuugagacaagguuucuauguguaguccugaaacucuauauagaccaggcuauccucaaacucagacaucugccuguuucugucuuuccagugcugagauuaaaugcaugugccaucacugacgagcuaaaaaucuuuuaaaugcuugcuacuaaaucuuuuaaaugcuugcuacuaaaugagauauuuuuauuguuuuucuuaaauuguaucuuauuuguuugagugucuugccugcauggacaucccuauaccgcaugugugcaguacccacagaggccagaagagggugucagacaccuugugacuguaagccacgaugugggugcuaagaauaggcacuagaagggcagacaaugcuuuucucacaacuuucuccccagauuuuuauauuuuacauuugugaugguuuaaauauguuuggcccaaggaguggcacuauuaggaaguauauggccuuguugggaguagguauggucuugugagaggaaauaugucauuguaagcauggguuuuaagacccucaucuuagcucccugggagccaaucuucuccuagaagccuucagaugaaaauguagaacucucagccuaccuggacacugccaugcuccugccugauacuggacugaaucucugaaccuagaagucagcuccaauuaaauguuguccuuagaagaguugccuuggucauggugucuguucacagcaguaaaacccuaagacaaucuugaacuuuuuuaaagguccuaauacuguacgaauaaauacacaaaaacccaagguggggauugaggagauggcuuaauggguaaagugcuugcuuugcaaacaugaggaccuuaguuuugcucccuagcacugacagaaaagcugcauaagguagugaacaucuguaaccugggcccacaauaauggaggacaaaaacaguggguucucagaacggggacccaauggucaaccaaucuagcugaaauugcaagcccgagguucaaugagguucaauguaacaaaaaauaaguuaaaaagcaauaggagaagauaaccuguuguugcucacuuucaauggacacauaugaauguacauauacagcacaagacuaagaacagauaauggcugguaaaaguauauuuuuaggcaaaaguaacauagcaagaguauccacacaaagagacaccuggaaagaaugaccaggaugaaaggucaaaacugaaaucuguuuguuuauuuuuaaaucucaaaauccaacaaagcacaagaucugagggaauccuuuuccuucuguuuggguuuggguguuguugcuguuguuguuuuuguuguuuguuguuuguuguuguuguuucaagacaggguuucucuguguagccuuggcugucuuggaacucgcuuugucgacuaggauggcacugaacucacagauaucgccugcuucugccuccugaguacugggacuaaagacaugagccacgaugccuggcccauucccaaauauuugaccaaucaaggagccucauaacaccuaaauaaaauuccacugaacauauuccacaagauccuuuaguaauugagaaguuaugcccuagauuucagaagcuauaguauucaacuuugacuagcuaagucucaacuauagauaaacuauggacccauaaaaugaacgcugugucagcagcuuccagauaaacagaacuucugaaaugaaccccucucuuuaauccagcauuucuaacuguaacaacugguaaagcaugagcuuauuccucauuuuccaaagaaggaaggcaagagcuuccauuggacuuuccuaaauauccccaguuucaccccagugcaccauuuguaguauaaaaaaaucugaaauaagacaaaaacuucucauuuuauauuucacuuugucagaucauguuaugacagguuuacuucagagguucuauuuaucuggcagcugcuggcaccaacagcauucauuuuuaugggaucauuguuugaaucuauaguugaaacuuaccuagucagaguugaucuuacaaguccaaacagcugagugaagacauauacaaagaaccuuugaccuaacauaaccucaaauuaauucaauacaauuuuaguaagcauuauagaagggacaaaguacauuaaucuuuaagcaaacucugaacucaaauuugcauauauuuccuuucacugaaguuaguuaggcuuugagcuuucaaauucccacaacuuucccaguuagcucucucuaccucauagugucaaucaggauguaagcuuuuaacuacugccccagcuccaugucugucugucuggggcaaugcucaaagccaugacggccauggacugacacucugcuuugagccgcaaauuaaauguuuuguuuguuuguuuuauaaguuaccuuaagaaugguuuuuugucacaacaaauaaaauuaacuaagacaaguauuuugucaaacagcauaauucugacuacuauacacuauucaauaaacauuaauuaaaaugguauaucuuaucugacacuucccaaggacaaggcucugaauaagucuaaaaaucagagaauaaauagaacaguaucagaaaucuuaccguauuuguacaccacccacaauuuggcccugcuuguauacauucuccgcaagauuuggcauuugcuuuuaaacaucuauuuuuaucuguuagaaaagaaacaaaaacacuguacuuuucaguaucuuuaaaguuucaaagggaaaaaaaugaaaagaucacaagaaaaacagagaccaggaauaugcaaauaaacauacauguuaaaaaugaacaaaugcagcccaguuacuaagcuauaccaggcuacuccaaagaaaaccuaaugaccugggguccccuugacacugagaaccacaaacggcaaucaucuugucuuuuugcaugacacacuaguacuaauaccauuagccuagcuacacaccauuagaccauacuguugacacuguaauuucagcaccuauuguucugcggguuauaaauguccugguacucuuauaccuaggucagguauugccuuuuccuuaugacugacaaucucaugcccauaccacauaaaugucuucagggcuuccacuccacuuuuaguauguuaaauaacugccaagcccauauucauccaacucauaaccaauugagcuuucauuucuuugacucaaucuagacuggcacauuuuuacuuguaguaaauacuagaaagacugucuccaguuuucugauuagaauauaaacuaugcuugaagugaaaaauuuaagauaaccacccuaccaauuuuagguguguccucaggauacaguuucugggggcuguagauuuuauguaucauuuccuacucaguaucuuucaucauuuucacauguccaucuugagaugagauaauucuaauuauuuuauauacuaugcuuuuuuaagacauagacaguagaacaagggaugguuaugguugucagagaaauuuaaacuaucuucagcuuguuaccugcucuuauagauaugcuaauacaagacuucuugaucacagaacaagaauuucuucuagaaaguaaacuucugaguuuucuuccucuucuucuucuuccuccuccuucuuccuucucucucucucucuaguuuuuugguuuuguuuuuuuucuuuuugccacuccaaacauagagcuuugacugaacuauauuccaacccucuaggauuuuuuuaauuugggggauggagaaggggggguuguaucuagcacaggcuagccuaaaacucaugauucuccugacuauuucugccuuccaagugcuaggauuacaggcaugugccaccauguccagccuacuuucccuuuuuagaugcuaauggacacacuuucguuguaauccaccaaaguggauauuuauuuuauuugcuucuaaauauauuacaugucucugccuuuguucuggucccucuccagcacucucacauucuccaauuauuuuuguguggucuaugacauacugucaugugagcucucacaauccucacacugaagucagggaugauuaacugauaaugaagaccccugcaggcuccuuggaaaccuguuuuucauucacagugagacgaugcugcaaauuuucaggaguguugugaucugauggaggguugcccuucccucuagaaucuaacugaccaaugacuauugauacaagaugcugaaauaaaaagauaacaacaacaacaacaacaacaaaaaaccaagaaccuuuuuuuuuaccuguuuggccaaauacagaacaaaucaaacugaucaauccaauccaggaaaccaguugcaaauucaucuauaacagaaaauguauauuauuauugauagagaaaauauuacauuccaccuucccuucuuuuucuucucaaucuauuucucuccaaacaucucuacacugccaucugccuuucuuccagaugguuaccuuucaccuacuucacaccacacuugcagaauguguuucugucgucucuaaaugaaaugucuuagcauucaauuaaacauuacaaaauuacauacauucuaaagaaaccaaaguuaguauuccuacagcagaaagcuguggcggcuuguccuguagaauguccaucuacacagucuccuggggcucucaaccuaauaggcacauccagaggcccaguuaccucagaaccaagaguacuuuccagcacugaaucauucaucccaugcugacaacgcaaagaguuuuuauuucuccucaggcuaaaacaugaauucauauucaagguucugacucauuuuuucugugugcuuugcuguuauuuuuuuucuuuuguaagaaaauuaacuaugcaugggauugguaaaauacucagcuugauucccucaacuuucuacagcaaaaugccuuauuaaaccaagaaucuguauuguccuuuagaaucucaggguuaggaggugaggaggaaagagaucagauaauauucuauguauuaaacaggcaacuucuauucauucucucuauuucuauucaaccaauguuuucauuccuaaccaaauguguucaaagacagcugagacugcagacuacucagcuaacauguuaacugccuucuguucauaggcauguccagucuagugcacaugcauacacaucugacucacccacagaaugaaagcagaguaaggaaugcuggcaugggcauaaucccagaauuuaagaggcagaggcaggagaauuaccauaaguuuaaggccagucugaucuacacagaaaaauucugucuugaaacccaggaaaagaaagaacauugggaaaguggaggcaggagaaucagacguauaaguucaucauccuucccuagaugguaaguucaagaccuaucuuuaaaaaaaaagaaagaaaagaaaagaaaagaaaaggaaaggaaaggaaaggaacgggaagggaagggaagggaagggaagggaagggaagggaagggaagggaagggaagggaagggaagggaagggaagggaagggaagggaagggaagggaagggaagggaagggaagggaagggaagggaagggaagggaagggaagggaagggaaggaaaggaaagguucuuuaguucuauuuuaacccugaguauuucuuuuaaagaacagcucuucccaaagcacagaaaacuuugcucuggucucaggucccuuucauaugagaaguaaaggcagacaugcuacugugcauugagacaugguccuaaucuuaagauaaacacuucugcuccacugcucaccuagacuucccagagacaagagagguagcucugggagucauccacccgcaaucaggcuuccuccaggaaaugagucucuccuggggcugacagguugaugcagauagcuugggacugcauccaagaagugaauaaaaccugagugucacaaauguaugauguucuaaggguuaggguuacaauguuguaaaucauuacagguugaaauucucaacaauuucaauagagccacugaugacuaaggacagagaacgugucacuccaguggaaguggaugaucacaguaugaggauggauauacuccuucaggcuaccuuaauacuugcugaucagccuugagaaaucuuccaaaauaccauacaagucagagagacaaacuaugauagaaugaaaaagauaauguuccccaauauucugaaauacauuacuuuaaaccauuacuguaagugccacagaccucugcuucuuuguauccugauaggccaaagaaccuacuuacuaaagcccucauaccucuggaagugugccaccacgcucagaagaagacaaaacaaaguucuaguguucaagaacugcugagagaacuaggacugucuccaaacaucuuggagauagucaucaacucuucuguaaggaucuguaagccagcaggaaacagaggagcuauugcuugguggcuuucauaaaugcuggguuuuagggacaggaagaaguaagaauucagcaggacucuaaggacaaugacaguaaugagaaagcaagagcugggagcaugagacugagaccauacuugagaguggcccuuagggaggcggcacaacuggaaucuggaccaaagugccugcccgaggcagaaugggggaaggcuugagaaagacuacaucacaguucacguggauguccuucucagacauaaagcuauaacauauaaccuugggcuaugcgaggccugucaacaaaugacucuauacagagaaauggggcuuagagguucccuagcaauggcaucucacugaagacaacucuucaucaucuaugaggauuauuucuaaagauuaaaguauguuguagaaacagucaaaaugaaacuuauagaaagugacuaugguuuugugugugucaucaaauuuuuaaagucaaaacuaaauaaccucagauaaaaucagggcuugauucuguuuauaacaauaagguuuccuuaaauauugaucuauucugauaugcucuuuaaaauguuaacaagugaucgcuuaaaaaaacaaauacuuuuaauugugacaacuaaaaugcagaacuaguuacagucuuuuucaagaguaagaaaaaccagauauuuauuucauaaacaacuccauucugacuggacaacaagauucuauccagauauaucuuaccuacuccuagauuacaaaugaaaucagcuuucugauucacguuucuuacauuaaauacacaauaccuucaucugagaguauaagcauaaucucauuuagaaaauucuggcugauacucaagugccccauguaauauaauguaaacauuucucuaacuuuuuuguuucuuaaaauccuuuuagaauucgauaucuuuguguauuuaguauuucacuugguauacucauaagugauaaauuaaugcuaaucuuguuuuuauugaauucaugauauuuuuccuuucuuuccccccaucccucccacucgauccagcccauagguuuuuuauuuguuucucauuaaggaugguuguuagccaccauguagauucugguauuugaacucaugacuuccggaagagcagucagugcucuuaacugcugagccaucucaccagccccaauauccuuccuuucauaaucaucuuuuuuguuaugacuuuuuacuuauccuaaacaucuaccuuauuuaaaucuuguuuucauguuuagaacauucacaaauauuuuuguguuuuuuaaggaaaaaacucauuauucgcuuuuaucuggguuaaagaaaucuaguuuuucaacugauaaaaacauuucaacaacaacaaaaaccaaaaacccacucuccaguuuggaaguaguguauuuuaaauccaaauuauuacugccaaaaaauacaaccaauuagacuacuucaggguuguuguuguuguuguugcuguuaacuucauuaguccagacaauauucuugauuauuuuaaauuucauauauuacucuaauauagaucccauguuauaucaaauauagacaguugaaaaucagaucuggggcuggagagauggcucagcaguuaagagcacuggcuacucuuccagagguccugaguucaauuuccagcauccacaugguggcucacaaccaucuguaaugggauucaaugcccucuucugauaugucugaagacagcuacaaauguacgcauaaacauaaaaaguauaaaccuuaaaaaaaaaaaagaugucccaccaugccacaggggcauguguuccacuaaguucauagcggccuuauuuaugauagccagaagcuggaaacaaccuagaugucccacggcagaagaauagauacagaaaaugugguucauuuaccaauggaauauucuacucagcuauauccugaguuuugcagacaaauggauggaacuagaaaauaucauccaagugagguaacucugacccaaaaggacaugcaugguauauacucacuaguaaguggauauuagcaaaaaaaaaaaaaaaaaaaaaaacagaauauccaaaauacaguccacagaacucaaaggucaaaaggucaacaagcugaagugcccagugaggaugacucagucccacuugggagagagaagaaaccaaucacaaguggggggggggggggggggggaaggagggaccugggagggaaaguggagggggagagggagaccuaucugguauugggugagggaaaaggacugaagcccugagggccagcagaaaagaauggaaacaggcaaccucaggaaauaggagguuggagggaucccccagaaugcaccagagaccuaggagguaaaauacucucaggaaucaaagggagggaccuuagaugaaauaacugacaguagggagagggaacuuacagagcccaccuccaguaggaagacagggcaucaagugagaaugggguugccaucccagucaucucugaccuauaguuguuccugucuaaaagaauuacagggauggaaauggagaggagccugagguaaagaaggucuagugacaggcccaaagugggauucagcucaaggggagguccaaaaccugacacuauuacugaggcuauggagcgcucacaaaaaaagagaccuaucaugacugcccuccgaaagacccaauaagcagcugaaagagucagaugcagauauuugcacccaacuaauggacagaagcaccugacuucuauuguugaauuagggaaggcugaaagaagcugaggagaaggacgauccuguaggaggaccagcagucucaauuaaucuggaccuccaagaucacucaaacacuggaccacaaaacagacagcauacaccagcugauaugagguccccaacacacacacaguaaaggacuucccggucuguguucauucagagaugaugcaccuaacccucaagagacuggaggucccagggaguuuaaaggucaagugggguggggggugaggucauccacauggagggaggagggaggugugagaugaggagcugucagaggguagaugagggaugugguggggaauggaauauggaguuuaaaaaauaaauuaauuuaauaaaaaauaaauuaaaaaaucagaucugaaccauaauggcuauuagauuuuaaugauauaaucuagaagguuuuuuuuucucccuuuaauggcuuuuaccauauguucuaguuugcuuuauguugcugugauaaaacacugaccaaaaccaacuugggaggaaaggaaguguaaaagguuuuauacuuccagguccaucacugaaggaagucagcacaagcacgaacucacucacucacagaggaacacuguuugcugggcugcuuccucugguuugcucagguaucagcccaggucuaccagccuagggacagcacagcugguaauggaacgggccaaacuacgucaauuagcaaucaaaaaaaugccccagaaacaugcccacaagccaauccagaagaagaauacucuuccacugaaguucccucuuucuagaugacucuagguuuguguuagguugacagcugaagcuaugauaccagguauucuucuccccuuaaagacugcucaccugccuacuaaucaauuugaucuacaucagaucuuaaugagccuuuccuuaaaaaggagauaugaaugauauuuaauaaguaaaauguggcuaccacauauauaaaaugugagauaugcucaagaguagaaacuguaagugaaaaucuccaaaagaagcugcauuuugaauugaaccaucuaugaggcugacagacugauuagaucuucaaugacuggagaauuuggaauguugcaaguucagagcuaaaaacuugugccaucuuuacccucuuaauagccaucuauugcccuuauggugguuugcauuagaaauguuccccauaggcucaagcaucugaacacuugaucucuaugugggaucccuauuaagaaaauuuaguauggcuagagaaaauauaucacugggaacaggcuuugaaauuaagacuuguaccauuuccaguuugcucucagcuucaugucuguggcuaaagaugugauuucucaauuucuuauuaaagcugccaugccacuccagcaugaaggacucuuacucuucugaaaccauaagccaaaacaaacucuuccuuaaauuaucuuggucauggcauuuuaucaccaaaacagcaaaguaaccaauacagcccuccauuagauaagucacuuggaauguagaaacauagcacuaguuauccuuuggaauguauuaacuuagaagaugaucagcuuccaccagcuagcaucugaagccagauuucccuacuuuguucuaacccaucucucuaacguuuccuuccaccacuguacuuagaaguaacuugauuuaugguuuucuuuguucuguuacauaaaacuacauaucaaacuggaacauggaaucuaggguaaccuaaaucuguguuuccaggucauggucagucauauuuggcucuagaauacaauggacaaagggaucuuuugagguguaaacuguguuuuacaucaacacaggacauaguguaaagacaccuaacugucuaacuacaggaagauggcaagauagaagcaugguagcgcagguacaaaugguaccuguagaguauggagagguagcugagaauuuuacaucaggaucagaaagcagcaggaagagaggaugacacugggccuggcuugagcacuugaaaccucaaagcccaccccaagugacacaauuucuccaaggccacaccuacuccaacaagggcacaacuccauagugccacuuccuaugagccuaugggggccauuuucauucaaacaaccaugucucuaucauaaauacacauuauauuuuuaaaaucuuaaaaguaguucugagauuugcauuaugcacugaaaauagcaggagcugaguaagagcaaacacgcagcaggagccagauuacaagagguuaaauuuuguuuauugucauaauugagaagcagaaaagccuguggcaagauagaacaugauuauauaaacacagcagcaggaaauuaggggagaccaggauagggacgacgccuuacaggcaggcagaguuuaucacacaugucacaggcauguguugccucaugucuauaauacaaacacucaagaaaaauuaaagcaagaagaaugagaaucaaaggccagcaugaaauaacaugguguaaugauaagacuguaucuuaaaaaaaaaaaaaaaaaaaaaaaagccauugugucaaaauguacaccacaauagcaaugaggaaaugcaaacaagucuacaguuaggugguuaagguaauuacuuauagguuaugauauuuguuuaauuaaggaaaguggggacacagauguggaucucgggagauaggcuggaguuagagauaugcacagaagagaucauuauucaagugagcaugcaugguguuaugaagaaaugaaaacucaggaagaaaagaaggcugagaggauacuaaaagucaaaacauggaaaagaaaaagacaaaugauaaagacaguccacccuggagcagagcagucacucagacuacugggaauguaucacucugaauuaggcacacuaauuuucaccacaacaaagccacuccccuaucaauuccuccucaaguuggaaaccaagauaacugaggacauggaaaaugggcaauaguacuauggagaagagaugugggcccagcagccacuguacgcacuaauuuauagaggugcauccuaauauuuuacucaucuguaacuacuuuuaauauuggucuuucccccaacggaucagguggggugggaguggggcaagagaacaagaucuuagugucuuagucacaaauauagcaacaaguacuuggcucaaagauaauacucaaccugaauguccccucccugaggacuagcuuucaugguaccaaaaagcaccauguaagcuucagaaagagggaagaaaacaagaauucuacccagcugugauaucuacaaaccacaacaaacagcauggcaccauggagauaaccugguugguuauugucuaauuggcaauuauuaagucuaauugacaccaucucaacaagagagaaaccaugcuugcuacuggaaaucuagcuaacuacucaguuguugugaagucauaguuauuggaggagaaucuacuaucucuaguuuaccaaaccaccauaaucacuaaucuauaaaugucuguccuuauacacacagauaagugcagccuucauccuucaccaaggaaacuucccuuugcaaccaagaccacuacagaaaaccacaaaaacucaaaauacagaguuguggagcccagucccaauagauacaucuacaaaaacaccuaaaggucagggaacauugaggaagaggcagcagaaagacaguaagagccagaugaucagaacauuugcuguuagcuugugucuucuaguaacaucugaagcuacauccaugaagccucuccaacaugaaugcccgaacaugagcugaacaaggaugacaccaauggacugagaaaagcacagaacuauaggcaacuaaggaaagcuguuguggggaaaguuaguccucuccccagagaugaacacacccauuggcuguccagugccaaacaauaagcccugaaaauauacacacauguaacauuauacaaacucaaguuauauuuaggaauauauauauauauauauauauauauauauacugcacauauaugcaugcaacaagaaucaguuuuuaaaaagaggcuaugaauuuaaaggagagcagaagaguauauaggaagguuuggaggcaggaaaggaaagagaaaaagauaacacucaaaauguuaugcuggaauauauuaaauuauacgaccuugucuucugacauuacucaggagcucagaaaggagacaucucugcuuuacagaugaaauugucaccugagcuucugaacucagaagcuauagccugauuuugagcuucauuaaguauauuuuuugaaggccuauuuagccacuauuuuagacggaucuagaguuagaauugacucagaccacagaaaugaaaaaaaaaagcuuauaauguuuuaugaguuuauuuaauaaacauucaaagugaauggaggccaacaaguuaucuuaauuucuaaauagaugcugguuuugugucuuguucccacaaaagcaucucauuaagauuuuuuaaagcauauucaauuuuuaucuaagguggcauaauucaucccugagcaaaauauucuuaaggauagcuuaaguaagaaacagccccacauuuauacaacuaucuuaaucuucaaaguaaacaagcccuucugaacuuuuaaacacuuaauuuuuuuaauaaaauauaaauaacaucugguauuuccuuuuacuaagacagggucucauuacaaagcccugacugaccuggaguagaucaggcuggccucagacucacaaagaucugcuuuccucugccucccaagugcugggguuaaagaugugcacucccuuuacaaaugauaucuuuuaaagcuugauauauacagauuaaguaucccuuauucaaacugcauagggccaaaaguacaggacuuucagauuuugaaauagcuacauguagugaaacuuagaccugggucuaaauguaaaauccccuuauguaacuuacauacaugccuguauugaguauuaaguauucaacuggauaauaccugcauaccacugauccugaagggacaacuaggugcagaauuuuuuguaccauguugacauucagagauuuacaucugaaccauuuaaauuuuucagauaaaggaagcucaaccuauacuauuuuuguagaaaucacuuacucuuaaaaggaaaaugacuuuaaaauuagggagauaucucagucugcaaaguuagaaucucaauucaaaucccuagcaccuguguuaaaagcugagugucaaugguguguguccguaauccuaacauggggagugggcaggcaaaggcaaggggacaccaagggguugcuacucaguuucugcucauauaggcagaugagggaggaacacauccucaauuccauucaaacagccaaaucucaucuccaauucagugagagaucuccaaagaauaaguuaagagaacaauuggagaacacauccucugucaacuucuggccucuacaaggaauguauaagccaguucacacaaaaugaaguacuuaacagcuggagaugaagcucagugauaaaacacuagcuuggugugugcaagacccuguauuaaacacuccccaaugcugugucuggauugaaaacagauaaugggauagagaaaucagcauuugaauaauacaaggauaaucuuuacacacuacacaaaaacauuaugcuuacacacaaggaagaagaaaacaaggacagugccuuagucagaguuucuauuacuaccacaaaaaacacccugaccaaaaagcaaacuagggagaaaaggguugguuauucagcuuacacuuucagaucauaguccaucauuggaggaagugaggacaggaauuuaagcagaaccuggaggcaggagcugaugcagaggucauggugugguucugcuuacuggcuuacuucccauggcuuguuuggccuacuuucuuauagaaccuaggaccaccagccauuuucucagcugaggcuccuuacucucugauaacuuuaacuuaugucaaauugaaacaaacaaacaaaaaaaaaacagccaguagagucagaaaaagaggcuagguaaccuaagaugggaaugguuuuuuguuuugggguuuuuguuguuguuguuuuucgagacagggguucucuguguagcccuggcuguccuggaacucacucuguagaucaggauggccucaaacucagaaauccgccugccucugccucccgagugauggaauuaaaggcgugagccaccacugcccggcuaaguugggaauguuaguagcaccucacugcagccuaccauccuauaaguacacaacagucucccuagacagcuucuuaaaugccagccaaaacucuacccugacugcaaacaaaagacuuuugaagaacucaaugaaaauccuuucuaaccaauaaaacauuugucugagccuaauaaacuccuacaaugaagguuuuuguuugaagcuaaguacaaugguucaugcuguauguaaucccaguacuuugaggcuaaaguaagagaauuucuagaaguuugaggcuagccuguuucauacagugaguucuagguugguuaugcuacaguaaaauaacaacaacaguaauaauaauaauaaauuaauaaguuugauccaaagcucacaaaaaaaaaucugaucucuaaaaacaguucacucgcaacacaaauacacaaaaaaaaauuuaaaaauacaauucacgacuacugaugauuccacuaucccaaggaaaaugagaguaucaauguccucuucaaaacucauaagcuccaggaauauaaucaacaaaacaagaucaaaccugaggugucacacaaaguacaaacuaccaaaggaaaggaagagccaacaagacagaauguguggugacagacaacugacaucuaccuccacuacccucaccugaaagaagagcagccccaagggcaagugucgaauucaaaucagucacuacaaaguuaaucuaaugacugccaaaugauggaaggagugagaauuuugguuucuuaaaaaacccaguauugauaugugaauauguuuuuguuuuaauccccaggugugggauaugggaccacuucagauuguccacaaccacuaugauuucucucuugcugcagaagugugauuuugccagcugcaaauagucuacauuuggaauuuuggggacucuugagagaguguaagugugagugccccaagagccugugguggcagcugcugguucugcugcugcuuuagcuauugcugaacugcugguuccugaauccugaguugcugguugcuggcuagagauauucuaaccaugaagauuggacuuguccaagaaccucgaagccccuaaucagcaggaagucuaacuaggucuaugcucccuuuccccucuaaccuucuucucaacuaccuaguuaguauuagggggguuggaaggaacuaggguagaggagugugguaaauauaagaacccaauaaaguagccccaaaaguauggcuacagaugaauuuugaaaauaaaacauuuuaagaaaagcuauaaaacgaaaacauaaacagccagucuacagugagagaagaaaaacugcugcccagcaccaucugcuaucauccuuauuaccuagcaaaugagacuuuacgaacuaaccuagcggucccuaagcuagcgaucccuuuauacuuucuacauaugcaaauuuuauccuuucuuuccuguuuuuuguuuuucccuaugaaugaggaaaauuaucaaauguuucaguugacaaaacuuauauuucacaaauguaaguguaagaggucuugcaaaaguuaacuaucugggcacuagagcgaaagaagggucagugcuuaaaaguacuugcuacucuugcagagcaacuagguccugaucccaagcauucacaccuggcagcuuacaaccaucuguaauuccagguccagaaaaucacaacacccucuucuagccucugcugggagcaaaacacacacacacacacacacacacacacacacacacacacacacacacacgguucacacgguucacacgguucacaugcacacaugcaggcacauaaacauaaaaauagauaaaucuuuaaaaaagaaaguuaacuaucuguuaaugguaucaaaagcauuuucccuauacauaauuucaauuaggaggaauuuugaguuacauuucuauauugcauaaucuuaucuacugguuuccaaaaaauuuuucuggauaaaaguucacuuugaccaccaccuuuuauccuaucuuccuucucucaccugguguggauggaauaagcacaauccaggcauacuuuauacaacaaauguuuaaaaaucaaacuauagggcuggagagauggcucaguggcuaaaagcacugacugcucuuccauagauccugaguucaauucccaacaacuacaugguggcucacaaccaucucuaacaggaucagauguucucuucugcugugucucaagacagcaacaguguacucauacauaaaauaaagaauguuuaaaaaaaaaaagcuacagauaaguuacuucauuucucauuugacucaagacuaggcuaggagugacgcauauuucagaauuugggaaaggauaaaauaugacccugauggaaaaguuuuagcaacaaauauuucuauacugauuuucuuaacacugggggcgggaucugaauaacuccuuaauauguguuucucaacuuuguuguuguuguuguuguucugugcuagagauugaacccagggccucucaaguaugaacacaagagacaccuccaauucuuuuaaagucaugcuuccauacuucuuuaaucaggauaacucaugccuauuuuauuuuauuacauuuuccaaauguagaauuaggccacuaaauguaguuucaaacuucaauaucuuuuuuuuuuuuuccgauuggauauuuucuuuauuuacaugucaaauguuuuccucuuuccaggucuccccuucagaaaccccuaacccaucccccugcucuaugagggugcucccccacccacccacucccauccucccacccuggcauuccccuaaacuggggcacugaacacccucaggcccaagggccucuccucccacugauguccaacaaacuucaauaucuuaauuaucaaauaguauaauauuccacaauugaccucuaagaaggguaaaaaauaauaauaaaauaaaucauauauagucuauaaaauacuggaggcauuagaaagcuauuugcauccuaauuucagaguaugaaauuaaacauucaauaagcauauagacugaauauguucugugcuucuaaugacauuuaccagaauuugcauguaaauauuuucacccuuccacuugaaacuacauuccuuaagcaaaaugcaaugcaaauucuucuaccuuuaugacuuuuacuuguuucuuuucuuuugcucuuuuuuaaauacaucuuucauaucacccaucagcccauuccucacucagaccucaucuucuccaucaagccuuccaaaaccacuuaagccaccacugaccuuuucuucaaaaaaaacugagaguaucaucugggauggcacacuguauaaacuauucuuugucauguuuuccugaguggaacacaauugaaccaucuagggaauuuacucaaaaucaaagacaugccgaccccugaauuacacucuuugagcacaugucuuugcaguggcaaugacucaguacacugacgagcuacaaugcaaugcacuacuaaagacacccugacaaagagcagccaguuacagacgugacaaaucagcccuggcacaaccaguguuaauugcacagcaucuauacuuucucauaaugacacaaaacgguugcucaggcaaaagagggcucaacagucaagagcauuugcugcucuuccagacaacccaaguucaauucccagacuucccauagcuccuauuagguggcucacaaccuucuauagcaccagcucuaggaaaucuaaagccucuggccucugaaggaacuugcacucaugugugcaaagucauaugaagacauacauaccuacacauaauuuaaaguauuuuuuuuaauuuaaagaaaaugguuucucaugaaaaaacaaaaauuguacucuucaguacuuagaucaggcagucacucccucuuaucucaaagugagagcaacagugcagaugugaaaccaaagcccuagggaguggugcaccaaugucauacaguaauccagguucagcaccugcacugaaagccagguuucccaugugaagccucuccucaaucaaacugcagcucugaucacugcucugggggaaugggugugaaaaauaaacuagucuuuaauuuaaacaugcuaauugcuggaaacccccacaaauuccuacacucucuaaaauggccggcaaaggauccaaaaguucaaagaaaaugggaaagugaacgacuuucccuacucucaagagccuucucuacucuacacuccggugcuuuuauuuugcagccuauacuaucaaccagcauugauagauggaaaauucccaaacucuaggccccauggucaccuuaaagaacucagcaugguagauccuacgcucuuguaguagcacugccucccuggguaaaugcaccaccuggccauucaccuuuccauuucccucaacaugaaccccaggucaccaauuccccuuccuacacaacauaauucuuguuucccuacuggcuaccacuugggaucuauaagcuuuuugaguuucaucucuaucacuagaaaaaaaauuggccaugcacccauuauuuauaaauuaaaacauauauuuuauagcaaugcaauaacauuauacaugauaaauacguugaacuuuuaaaagcuauaaacagagaaugcucuuauaaaaugcuuauacucaaaagccgggcaugguggcacacuuuaaucccagcacucgggagguagaggcagguggauuucugaguucgaggccagccuguucuacagagugaguuccaggacagccagggcuacacagagaaacccugucucgaaaaaacaaaaaaaaaaaaaaaaaaaauaaguagaauaaaaugcuuauacuccuuacagacuauuaaguuauuuuacauaacccugggguuagaaaccuguuauuuugaagccuugguaaaaugcuccuacaaguaagagauauguauguaugcauauauauauauauauauauauauauauauauaugcuuguuuauauaaauuuauauuuguaauauuuaauauguacaugcauuugcgugcauacagauauauaugggcauguaugucugcucuaauaugauauauauuugaaggagccucuuuucucacguauacauuuuaugaugacauauaugcuagacauacggguaaagauaauuauucuuaucuucuaaagccacacaccaaaaauaaaguuuucaaacucugaaaaauuuacaauauacaugcuagacauauuuguaaagauaauuauucuuaucuucugaaagccacacaccaaaaauaaaguuuucaaacccugagaaauuuacaauaugcaugcuagacacauugguaaagauaauuaucuuuaucuucuaaagccacacacagaaaaauaaaguuuucaaacugugaaaauuaacgaaguaguuuauucuuuaucacacagcuccugaaagugagauacacugcccucaccuaucuacgucaauuucuaagcagucagaauuguguggacuguccuuuaaccucaguacacuucugauuucugagacuguauacugcuacuacuuuagaucugauccagaagacucaauuacuaucuuuucccccuuuauccucacauuccugauugccaacuauuugacauaugauaaacaaaaaagucugaaaaccuauaaccaaagucccaauaaacaguacuauaauagaaaacacuaaucaacucugaaacucacuaauuugcaaacaaaugguaaaagcuuauuuuaucauauucaccccauaaugaaucuucaagucagcugggcuuauuacacuucaaaaacuuuuacauuuaaauucugaggaaaaaaaaaacaauccucugaaacuuuuacuagugucaacauguuuaucucaucacucugguaacacagguaagaauacuaguacucauacacucacggaacacuaauaaaauuauuuucuccagacaacaaacuaugauauacaccucccucucuacauguaaaccaggggguggggcucuguuagaaaaacaccagagaguaaaggaacuacauuaggcagaaagcauucuggacaaacauccgucaagcuaauuaauuuuccuaguaauaaagagugaggagaggugagcaguguucauggaguuaaucaauacagaacuauauuuucauuucauugauguugauucagaacagauucaaauuaggcugaccagaaaauuaaagacaacugauuacuuuucaacuuuguugauucuguaauuuucauguacaauacugaagauuacaaacaaccuggugggaggggguaggggaagacaugcucuuccagaggaccugaguucuauugcuagugcccacauaccagcugacagccacuuguggguacuguuccaggagauuugaccccucucuucuggccuccacuggagcggcauacacacagggcaaacuuacaagcaggcaaauacgcacccacauaaaauaaacaaaucaaagccuuaaaaaaaggaaacaaccucaaacagugagauggcucaacacaugaaaaugcuuacccaagcugggcaaccugaauucaaucccugaaauccacaugauaguggaagaaaagaagaaaccucacaaauguauccucuaaccuccaccuaugcucggcauacauucccacaugcaaauaauuauaaauuaaaauuaaagaaaccaucuuaauacugaacuucauauccucaacaacagauucuucaacugcaggccuguaaauucaacagauaagcuagaaacugcuuucuacucacauaaaaacuagaguucuaguaucuucuacucuccccaagugccuauauacaacaugccaguguuucauccguuuucuauuugucauucuaucauuucugaucauuaaccaugguugaaugaaucaaaauuccucauaaacuuggauaucauaucauauauuaagauucugaugucaguccuucccuucgggccuugauguccaucaguaugcaagagguaacucuaaacuaaaauuucuuaguccauucuacagguuaucuaggauaugaccuacuguaauggcugugugcgauuuaaaaaagaaaucuaaucagaauucaucuaacauuuauuucuguccuaugcaagcaacaaccaccauuaaaaaauaaaaaccuuaagucauacuauccucuucauacccaaguggaauggcauauccaggagacuuuccuaauacuaccaaaacauucugagaaguuuguagauuuuuuuuaacauagcaaaagcaaugaaaaguaauuaauguauaugaagcauuguugucuaaguugugguuuuacauuucacuaccuacuguguccuuuucuuuuuuuucuuuucuuuuuuuuucuuuucuuuuuuuuuuuuuuuuuuuuuuuuuuugaggcauugcccuggauuccucuugccauacauauacauacacacacacacacaaaaugccuucuuuauuuuacauuaguuagguuacuuaaaguucaaauauaggcucuggaggugagcccaugaacucuccaaauuacuuaaaacuccugcaccucaguuucuuccuuuguaaaaugagauaggcagucccaauaccaccauggaucaggaucaggguucugcagugaggucaguacaugcugggaguuuacaugcugggagcugggucugacccucgugucacaagaauuacuauaauuaguguaggaacuccuuuucucuuuuaaagaugaggaaacggaaauaggauaauuuauuacuaguuauuacuagguuucaaauuaaaaguucaaauucacuguggcauucgggaucagcgcggucauuaacccagccugucacuaggaggcacgagaaaggguaggcagccacacuccacgaggccccgggugggcaccgccucgcggaccacgggcgcugcggccugguucccagggucccgcgccgcgcuggggaaaggcgcccgcugggcaccgacggaccgaaccccucuaaggucagcggcacccagaucccugucguacccacccuugaaccccgccacgccccggugugacagacugggcucgcgacccucccuuaggacaaggccgggcggggcggggagcugcagccgaacgaggccgagcgccgcggucccuaaaaccggacuccacccggcccaggccgcagagacacgccugguuagcccgaguugcccggagcccacgcccgcacguccacacgcccgcggccuuaccuuuucgcagcguccgcccgacacgcgggcggcccgggcuccgccgcguuccgccucucggagggucucgggucggugucggcggaccucggccuuucggagggucucgggccggcgucggcgggccucggcuucucgguuggucucggguggcgucggcgggccucggccgcuccgcgg

SEQ ID NO: 12158 - RNA, 72589 nt, Mus musculus
gucuggagccaaaguuucugucucaguugggacgccgccgcggccgggggcaaagaaagggaggaaggaaggagcucgcggaggggaggggaggagaggggaggcggccucgggcaaggagugcagggcgaugcgggcgcgcgucgcagccccccgaaccugagcgcagugccccgagcgucgaacgaggccgcagccauggagcccgcgcaacagccgccgccccagccggccccgcaaggccccgcgccgccguccgugucuccggccgggacccccgcggccccgcccgcacccccggccggccaccaggucgugcacguccgcggggacucggagaccgacuuggaggcgcucuucaaugccgucaugaaccccaagacggccaacgugccucagaccgugcccaugcggcuucgcaagcugcccgacuccuucuucaagccgccugagcccaagucccacucgcgacagguaaggguaucccgggggcgcggggccgcgugggggugcggugcuggggguuguuuucgcggaguuggccgcagggggggugcacaaugcgcgcgccuccgcuccgcaccuucgcucugacgagggggaggggaggagggggagggggccggcgucuugugcgggaccccagccggggguacccgaucuccccuucccgcgccacugcagucuccgguggagcuguguuaacugcccucuuguuuucgcgugccggugagggguggggguugaacugguccauugaguuucugguuccuucucccgguccccucccccucccucucccgaaagcuuuucuguucucgcggcccaggcgcucuccggaugcaggguucgggcuccccagcccgagcgaagcucccucgaccccccacucgccuccgccgugcccuggaacucgcgcgggcgggauccuuucacacucggugggcucacguguccuuuuccuaaaucguaaccuauuauuuacuguucggcccgaaagcuuuuaaaugagccacgucuguguguugcgcaggagcucggcugcgcucacggugcagagguuucugcgccggccuuugauagcgcguugcagguugacucauaggccgaguucugcccggcucaacugugauuaaagguaauguuugggaagcaaugacuaauuccaagcucgccauugcucuuuaacugacugcggaugugaacauggcugcuuauccguauccacgacgccugguuauuuucccaacuggauccagcacagaagugaaaccguuucaaaguauuaacauuccgauagguccugguagauuucuuuagugucgcuccccccgcuuuuaauuacuuaauuuuuaaagaacuugcuuuaggcuaaagcagcacaggaacuuugcccaaaacuuaauugguuuuccaaacacugccaugucguuagcccacucgggcuguaacuugaguggaaagaagaguugccgcccccacuccagcccccccuccuaggcaggcuuguuguagaacgggguuuuugaagcuucgaaaaucucgauuaaccucccuacaaaaagccucuuaagaaggaaggaaaaguuaucuagcugcucggcuaaauaaacucuuaauuuguaacaacaguagaccuagauacuauuugcucccucccccacaagugaguuucuguacucgcugaacuaaacguaugugacaugcaaucgagaaaccgcuggggcaacuuugaaggaauacacagauugaacgcuccauuuuguagcacuuagaagucagaaggaaugaacccgggaaaguguacuuguaauacuggcuuccacugggccguucguggguacauuugcauucucucuaagcguuuuaagagagcuguucgucaauaaauuuaccuuuucugugcgcuaaugguuuccuaaaauucaaucuaucuggaaacucaaaaacgggguuuuccuauggggcuuuaaaugacugcugggucuuuucaguuuccuuaucaacauaaaucuagaaaaacguuuugagaaacccuaauuccaauaaaaggauuggacugugaaugguauguaucagaguuaguaaauaaucauccacaggccccugccugagaagucuucuagcccuauauccucucgcuuggaaaagcucauuuacacacaaguuuauuccugaccccugucuuaacacuggucugauuggacccaaauuugaaucauuggggucuuugcagauuuuucuuuugucccucacccagcuauuauaagugugugaauccacaaauuauaauugaauugaaaaagucuuucucuaggcacaaaaagggcuagccuauuauucucuucauugaggagcuuuuagcauuggugcaguucugagaguuugaauuuauuaaauguuguauaauuuauaauggcugacuuaucacauuuguuuacagucaaaaaagugaaagaugggggaacauuagacauuuacaacaaagaaaaaagugcccagucguuccccagguuuuguucuagaaccuggaaaaguaaccacacugcuuagaaaaguacugauuauuuugaguuauguaggaugagcauuauucuuuaccacuaaauaaaguuauuaugccuaguauuuguuguuuucacacugucuaggagguagacauucauccagauggacuguucaucaguaaaauaacauuuauaaugccuauuaaauuuuuguaauggucuauuuggucugguguguuccuguuguguaagaaauuaaacauuaaaguuuacauuugauacuuagauauuugguugccgugacauacuguuuggaaguuagggguaggugcuguugucucuauuguuaauuuucauuuugcuauuccugauaggccaguacugaugcagguacugcgggagcucugacuccacagcauguucgagcucacuccucuccagccucccugcagcugggugccguuucuccugggacacucacagccaguggcguugucucuggcccugccgcugccccugcagcucagcaucuccggcaguccuccuuugagaucccugaugauguaccacugccagcaggcugggagauggccaagacaucuucuggucaaagauacuucuuaaaguaagugaagacagcgcugggaagaggcagugugggaguggcuuuauucauuuauugucuuuuucaaaacaguauucaauuauuuauuacuuugcuguugcuaaacauggaacucagccuuauaaaugguaaaccagcauacuuuaucauugagcugcaccccagcucacucgcucugugugugucucucucuauacacacacacacacacauacacacacacacauaugcacacucugucucucucacucucucucuuuaggguuggucauaucuugaaagccugauuuauucuuaguucagagccuuuuugcagacuuuuguggcaaaaugagauaauuucauuuugaauuuguaccagauuugcuaauuagccuggcacaaaacaaaacaaaacaaaccaccaaaccuggcauagacauguguucuauuaucucuuuugugugccccccauguuuguguccaucuguuucuguguguguguguguguguguguguguguggugguggugguggggggggggcuuuaaaccaggaccuugugcauucuuucagcauaaaugauugguagagaagggaauauagggacuuagggaagagaugacguuacaguccuuaaauugugaaacaacaaauacuuuagcaauauuuuugaugucauuuaacagauuuuccccucaaaaugugaagaaaacauuaguugucagguuuggccuccaaucaugaggugacacacuuugccuucaaaagcagugucugcucugggaaaauguaagcaaaacuuccucguuacuaaggcccacucccacuccacaacaaaaugcaaaauuacauucaucugaaaaggacaaaauuaaauuuuauccccucuacuuuugacauuggaaguaaaacuaauuuucuagagcuuauuuaaauuaagaguguacaaaguaucccugacugguuguuacagacugaagauuauuguauuguuauuagaauugguuaacuggguugagauaaugcagugacgaacagcgcucauuugauucagauuugucugacuauccaugggaaauguagcgguuauuggaucggaccccagugacaaccuuguuucgugugugacaccccucccuccagccucucccaccccugacuggaucucuauuuucaguugauuaucuugagugaguugcugauacuuuguguuuaauuuugguuuuccaggcaggguuucucuggaacuugcucuguagaccagguuagucucaaacucagauuguccugccucugccucccaagugcugagcuuaaaggcuuguacaagaugccccacuuugcuuauuacuacuuuauaauguaaggauacagacucaggauagauaucagggggacuggaagagauuugaucuugauuuuggaaagggaccccaccuccacccuuguuuguuuguuuguuuguuuguuuguuuuguuguuguugcuauuuugcacccuguaacuuugucuuuuuuaaaaaccuuuccugaugugcugguacccaugucaaaggaucagguuucaaggagaacaauaaagggccagagacugggaaguacacacgagccugguaaacucauccacagggacccacaggagccagaccgguccugcuuuaaacagccuccgaaguaaaugacuuggaagagaggcuggcugugagagauaguccugaaggggaagggaggggaaacaaaccagguuguuagggagaaaaagaaaggcuugcugaacuccucccugcugggucccaugcugaccuggggagguuuuaaacagcuuaauagccugcaggccuucaguuguggcugcggcugugagcguuuagcuaaagagcguuuaugcugguuuuacucguuuguguuuucuuaaaauugcuuguuuguugacaucugcauuuuuuuaaaagauuuauuauuuauuauauguaaguacacuguagcugucuuccgacacaccagaagagggcaucagaucucauuacaggugguugugagccaccaugugguugcugggauuugaacucaggaccagcagucagugcucuuacccauugagccaucucgccagcccuacauuuucauuauuugagugagcggucauuuuuuuggagcuguaguaagccucauuguagauucuugcuuuuaagaacuuuggaugauucuuuccacaaaaaguaauugcuuuguagauggauuuguguaguuacugcauacuggcuccaucuccccacucugcaacccucacucuuuuucaaggcugcuggaaagaagguaaaguagguuaaacucugacuucuauagaagaagcaaacacagcaggaagugaggaaacacuguuucugagguugccaguggaagucugugauaaaugaaugggccuuugguucugcagagccuuuucacacugugcucugaaguagaaggcuuuggccugaggggugaccugacagcaggugaacugagucacuggaucugauaaagaucacguggagaccucugagaauuagaugucuaguguagucuugguaguugcuuugucaacaguaugcgguuuggaaaaucgaugugaagcagaacuuuuucucuuucagcugcuuucacugguguuaaguguaguugccauaaggagcuguuaggcaccgaauggaugcauguuaacaucuuccugacugaguaggagacaacagcuuuuggugccaaguagcuaucuucguuuuuagaauacuuuacuuuuguuugagguucuuauaaagucccaugugauggaaggaagggacugcugugauguguccauauucacacgcaugugcacccagagaugcauaagcaguagcuguaauaacauuucagaaggagacuccugcccagcugugggaugaagagcuggacuaccuucugaacuugagcucauuccagccaugaaaacuaagugacccuucccuuuaucuuuucagguacuuauuggaacuaacuuuuaaguuacaaaguauggccuuucuugagauuuguacuuggcaggaagaauucuaaccccaaaugguccaagcuggcaagaugaugucauuugagagaucugggagaauuguugacuagggaacagcuaauuguugccuugugacuauagaugaaugaguuuggaagucacuuggcccauccuccaguuucacggccaucugucuaauugcugugauugguguuaaaacccacccuaggucagugagaucuaaagacuuggacuuuauauuggaaaugauagggguggaucuaucauucaggcaccuucauucuggacaggaaccuagacucuggacaugaugcugugccugaaaaggcucagucuuuguagauauuacaucuuggccacugaacuuaaugacuuacuguuugaaacuaauuucaucuuaaguuuugauuuuaaaagaaucaauucccuuuauagcucagcacuucugcagguuuuccuguaggaaauaguucuucaaguaguuggucaacaacuuccuauuucuuuuauaagcugcugaauaacuuccugaauuagcauucuauaauaucuuugguuacaaggggugcuucuacuuuucagucuauuuuauugaaucugguaccuuguaaccauugccaguauaaagaacauauuguaaacuguguaccacggaggcgucggaauuugaugugccagaugugauccaguaauuuaauacauuuguacauauacaauguuuuaauaauguucuaauagguuuuuuuguuuuguuuuuuuuguuguuguuguuuuuuuuguuuuuuugguuuuuuuguuuuguuuuguuuugguuugguuuuuuuuuugagacaggguuuuucucuauagcccuggcuguccuggaacuuaacuuuguagaucaggcuggccucgaacucagaaauccaccugccucugccucccgagugcugggauuaaaggcgugugccaccaugcccggcucuaauaguuuuaaaaagaugugugugugugugugugugugugugugugagagauuuucugaauagaaccaguucuaguguuuauagucuuugagauucaaaguucuuagggcuguguuuuguugaaaguuguacaguauuguagaggaugggaauauauaguucugcuacagcaagcauaaggcccgagauugcucaagcuuuccaggccaccuagggcagaauguggugggaggugcagauaaaggcagugagaugguuuggcggauaaaauccauguucagcaaacuaaugaucugacuucaauuucuagauccaagguaggaggagaaacaucuccccagaguugacugaucuccacagggccacauuuuuagugucucucacugucucucaucucucaccaauacagaguaauggucaauuuuggaaaaaaaagcuaggaaccagcuaccguagcguacccaguagaaacagggaaacagguggaugucugaguuuggggccaggcugcaugaagagacccugucuuaaaaaaaaaaaaauucacucugcucaaaaaaaaauagguaagauagaaaggauaaauuaaauggauuaagguuuugaauggcuuuuuuaaaaguauguacaaguuauuaacuagaguaucucauuccaucauuucaaaggguuauuuucucagauuuuuugcgaguugcucagcauuuagcuuagcugcguaccaacacaaaccaucccugccuaaugaguaguguuuuaguaguugacacuuuuucuuaauucgugcgugcgugcgugcguguguauguguguguguguguguguguguuaggggauguuuaagccagagucaguguguguguguguguguguguguguguguguuaggggauguuuaagccagagucuguguguguguguguguguguguguguuaggggauguuuaagccagagucuaauuauguggcucuggcucuccuagaauucacucuguagaccaggcuggcuucaaacucaggccaauaccucugccuuuuccaguuacugagauuaaagguauggaccacccacacuagcaguaguugacacuuuaaaacaauguaaaacaaaaccuuucugaaacccugaaaucagcucuuuaguaauguaaaggaauauuuuuaauugcaguuagagaaagaauguaaauuagacccuuaaugguucugaucuacucacgugguuuucugccuuaaggcucugggguagagguuagcucugguuuuucuuuguguuagacucuaaguuauauguuuguuugagguuaagaucuugugagugcccaggguaaccuccuuuacuguccaagcaucccaugaugaccuugaacuccuguuaauccucccgucacugguuaccagugggugucaccaugucuaguugagugcauuuuuagaguguuguuuugacagacucgacuucuguaggcucuugugacuggaauauggagcugccuuugaagagagcaugggcagcugucaaagagguggggcaagagaagaugggcuuuuuguaaagaaaaaaaaauaguagucauuuuuuuugcauucauggcacugcccucacuucccuuucuccuucaugaaacggacaggcgugaguccgugcauguaaauguauauucuugucaugguguauuguauacggagaucagagcauuuguaaauuaguucucuuccuuuaccacaugggaaccuagauggguggaccuugugguaaauucaaaguauauugcuuuuaguaaccgagauaacgcuccugggaagaggcagagggcugagcaaaaggcauggcugagaacaagcacuucugggccuccuggugagaguacuuugaagauauuuguuucccauagguuuuuuuguuuuguuuuguuuuuugagauaggguuucucuguguagcccuggcuguccuggaacucacuuuguagaccaggcuggccuugaacucagaaauccacccgccucugccucccgagugcugggauuaaaggcgugcgccaccacgcccggcuauaguuuuauuuauaagccaauaguuugggguuuaauuugaagggaguuagaggucaauuaacaaagggccucaguccuuuucugucagaugaaagggcagcagcccuccuuugguuugcguucucuagaggugaacacuugugagccuuuuaguuguuuuuuuuuuuuuuuuccccucuauaaaccuaggguugguuuggugggguguguguguuugugcguguucgugcgucagcauccucaaggcaggcucuguuucuugcugaccuggagccccaggacuccucuagccuccugcagaagcagcuccacaccugacuuucugcauugagaguugggugguagccaccucacugacaggaccauugcuagccugcccuuauaaauuucauaaaaugugcuguucgucuguuuuguuuuucucacccccuuccuuugcccucuuggaguaacugcuagauauuuauguauguauguauuguuuuuuuuuaauauuguuaggauuauuuauuugggguuuuccuauugcagauauguauaauaacuacugugaauuuuuuuuuuuuuuuuuuuuuuuuuuuuuuuugagacaggcuguccuggaauuuacuuuguagacuaggcuggucucaaauucagaaauacgccugccucugccucccgagugcugggauuaaaggcgugcaugggccaccucgcccggcucacuguggaacccccaccccccaauuuucuuuuuuuuuuuuuuaauauuuuuuauuauuacguauuuuccucaauuacauuuagaaugcuaucccaaaagucucccauacccccccccuucccccauuuucuuuagaacuguugcuuuuuccccuuccuuggacgcuugccaagaguucuuuguguccccaaucuggauuacuugaguuuguggcuuuagaguccuaggggcuggcugugggcugccacugccagacacugcuugcuuaguuggacucuaauucccucccuugguuuggucacucgagcucucuguucagcaaucugcagagaaaagugccgagacucacagccagugacugagacgcuuaacuuuuuuaaucagcaguuuggguuguagaauuuugagggcuagauucuauuuuucgcuaguuucuaguuuuacugauaaguuaaagcuacuuuuccacagcccuuaggaacucuaguuuuuguggucucucaggaagagcccaggucagugugagggaggccccucaugguuuugaagugcagcucuugaccugcaggcuggaaagugucuccugguucccagaguccuccuauauuccugggcuuugucaggaucuuugauuuaauucguuugguuguguugguuucuuuccuuuuagugauuuuuaugugcauuaguguuuugccuacaugugugucugugugaacuugccagauacccuggaacugugagcuacuccauaaguaugggcccugggaauugaaccauggugcaggcugggaauugaaccauggugcaggcugggaauugaaccauggugcaggcugggaauugaaccauggugcggcugcucuggaaauguucagugcucuuaccugccgaucugucucuccaguccugaucuuugauuuucuuaucaaucccaaaacuucuucaacuuuggcuuuuaaugguuuaguugguuuuugucccacuugugguggcuuauaccuuuaaucccagcacuugggaggcugaggcaggcgaauuucugaguuugaggccagccuggucuacagagugaguuccaggacagccagggcuacacagagaaacucugucuccaaaacaacaacaaaaacaaacaaacaaaaaagauacuuauuuuugcuaggcaugguaguauaugguuguaaucccagcacuugggaagcugaggcaggaggauuguuguuugaggccagcccugacuacaagugaacccuccagaagacacagacagacaggggugagggcggggaagcgugcaugcaagaguaggagagugcacuucuucuugauuuuggggucccauuucugaguuuacugugaugcaccuucaccucugggcugucucauugcccucuuuacaguuuccuuugccuucuuggcuucacgguaccaagacuuugaggcuggccaagacugggaauuugguauugucguuacuccugcuucuagccuguuucucuaaaugaaagucuauuagucuuuucucuaguggccuugagugaugugacuggugugacacuggguugaguaccaguguucugcaagugaucaguggcuucauccuuguucuugguuguacucaaugaaaggacacagagccucuggccccacuggggaacacaaauggacaucucaacuuuagcuuugacuugguagagauuuuauuauuauguuuacuaagucacauuuauuuaguguccauguguuuaggucacauggcaaccuguaggacaugguucuuuccucuccucuccucguccuggcuucagggguggaacucagguugucaggacuuggcagagcgccuugguuuccguuugguuuuguuuucagaaaggacaugccccagaacugugaguguagaccaggcugucuucaaauucagagauuuaucugccugccucccaaaugcuuguauuaaagacauguguccugcuuauuaagacagggucccacauagguuggccuggccuaagaucacucuguaguccagucuagccuugaacucugggcagucuuucugugucagccuuccaagugcuagaaauauaacccugccacuccaugcuuguaagagcugugaggacacagaggucacaguugcccucucugccucugaaucccaugaccaugcuugguauauaguugguggucauuacaaaaaaaugagugaagaaugaauguaucucuaagugucuucucuuugugaacuacuacaaaugcauauguguacguguguguauucauguacacacaugaguacaugaaugcuagguagcuggauaucaggggacccucuuuggguucguuucuuguguuuguaugaguucuuccauggagcagaugaugguaggaaaggcgcugcuguguguuuaacuaguugugcacccuguguucuacuuucuaugguggacaugcuuccuuuuuuggguccacauaugugugcagagaccagaggagucauucuuguucugagugggcuagacugucuggccagggagccugagggacccacucaccugucuaagcuuugucacccuuggguaccuaccuuuucuccucuggggucuggggaucaaacucaaaacaccccucucuuauucuuauuaaccaaauucuuauucccaacccccgccccgagugcuuuuuuuuuuuuuuugaaagauuuauuuauuuauuauauguaaguacacuguagcugucuucagacacuccagaagagggcgucagaucuuguuacagaugguugugagccaccaugugguugcugggauuugaacucuggaccuucggaagagcaguugggugcucuuacccacugagccaucucaccagcccccccccccccccccgagugcuuuuuaauggucaacucaaugaagucgcuuaugcucagucuuauggaccauugucacuuucucagacuaguguccugccccacccauggccauagaggcauuuuuggagagcgcuuuagagguucaggaaucucaaguuaaauguguccaugucacuugaaucggucucaucuccauuuuguucagugggggaaugccauccaggggaugaaugccacccagaaucauggcuguugucagaaaaugcucugggggagaugaccagcugugagaauaaaguauugacuggugugacuaugggagugugggucagugaaacaccguugucugcacuuccuucgaaggagacauuccaggacaugcuuggaaagaugagcagcagugacaggcacaccuccaagugcuucuguggggcuuugugguugguugguuuuagguuuuugacaggguuucucuauguaguccuggcuguucuggaacuugcuucaaacucagagaucuguccaccucugccucagaugauaagacaugaccuaccgcuuuguuuguuuauaagaugaaaagaaaauuccccacaaaagagguggggagcuguugaaaugcauauguuucuguuuuuuucuacacaugcuuagacugauaccagcuguguuucugaaauccugcagcuuggaugggcuccaggugaugaaacuggguguuguaugccacucaucugcuggaguagggcauggacuguccuguuggacuaguuacuaaaucucuuucggguggaaaacaaagccacugugccugaggacaagcuugcucggggacgccugugugugcugcacuuuugaguuaguacugacauacuucaguuuaccugggaaaggcaucuaauugccagacaugguagaagaagagagccaacucucacaaguuguucuguaacuuccacaggugugugucacagagagacacagcacacacguuuaauacaguuuuaaaagacuauauaccugggcuuggagguggggugugugguucagggauagaggaauauccaagucccacuuagagcacuauguaucugcauauaggcacauaagagcauagcucucaguaggggaacccgcuuuacuucagaccacacaguuuuuuuaccacagaaaacccacucucuggcauuucuuaguuugcucauuuugauguguuaauaguuucuuccugcucaucucuugguuuuuuaagaccagguugauuuuagacugaucugcacacuacauagcgcccaggcugacagcagucgucccacugcugccucgagcugcggagauuucaggcuuucuuccugaaucguuaaaugcuuuucuuugcacucaugugugcuccauugucugcuuguuucauaagcuuguggucuuuaugucacaggcaauguuaagggcuugcuggaugccacucacuaacuuggagccauggaaccucuaccguaugucaacauguuugguguuccucacugugggcuuacuuagcuauaagcucucuaaaggcaaaagaugccuccuagauuugcucauuaguuuggggcuauugaucaguggucauccugguugauaccuaugguccugguguaauuguuguccuuauucuccaaaguugugugguuugaugcuaacacaccuuucugaaagcacuauggagcaacuguguagguugucucaucacugagacaguaccuguaggggaaagaggacucauccaguucacaguuggacaguggggaaggcaugacugcuuuccuggcagugggagcacgaggugccugacuuaccugucaacuaaccaguaagcagagagccagagcccucugaccuuaacucucucccagauaaugucccaagcucaaaggugccacaaccucccuaaacuuuagcugcuagcuggguagcaguguucaaauaugugaacuugugggggcaguucacauccaaacaaccaagguaacuggaauauuuuacuuccuguaauuuuuuuuccaaagacaguuuuugaacuccugauuaucuuccugccuccguuucccagguucuaggauuauaggcaaggguuauuacuacagcuagcuucuaaaaauaauuuugucauuucuuaucuuccucucccauucuuauucuguaucacagccuggcugugaacucccuacguagcaugagcaugaccuugaacucccgaucuuccugcugaucuuccuccugagugcucugacccggagccagguguguuaacaaguauucuacuaacugacuauaccccaacccaauuguuucaguuuugaggcagagcuucguuguauugcccaggcuguuuugaaacccaagauccucccaucuccguguucccuguucccagggccaguuuauuucuuaaauggcaguugaauagagggugaucuugcccuguuaaucuuggaaauuccuuuuuauccguuaggccaguuguucacuauaagccagcacaaguccaaucacagaaacgagguuguuuuucuuucacuuuaaaauuuuaucuguaccaguguuuagccuguaugcauauguauggauagcauguauccuuggcguccacacaaaucauaagagggcuucagauucccugaaacugguggugguaagccacuguguggguacugggaacagaacuccaguucucuguaagaacaauaaaugcucuuaaccugaaccaucuuucaagucgucccccccguuuguuuugagaugguaugaccuugcuaaguagacaaaacuggucuugaauugggagcauuggagcagccucuuccuacucuguaguauugggguugcagguguguaccaccacaccugcuuuauguguuuuuuuuuuuuuuuuuuuuugguuuuucgagacaggguuucucuguguagcccuggcuguccuggaacucacuuuguagaccaggcuggccucgaacucagaaauccgccugccucugccuccugagugcugggauuaaaggugugcgccaccacgcccggcuguuuauuuuuaaaauagucuuguuauaugguuccaggcugaccuugagcugucagucuuuccucuccuguccccucaaccucugaagguccaucuggaauuaauuacagaccugugucaccaugcuguggagucaccaugccaggguucuuauuuacuucuuugaucgcuuuuaugagacuuacaaauaucagcauagcucuuugcaucacugcaugaauucagugaaucuuuuccacccaagauuuuaccuggggacuccugagggucugucagucaacccaacucuauccuuagcaguauuuucauucugagccgugauuuaaguuucccaagcuggccuugaccuuagucucagucucccacaugacugggauuaucgacucggaccaccaggccuggcuggcuaaguucagauauuucuauagcaguauggaucuguuguuugacuagacuacaggcuuaacuguuguacuaugaagaaacaugagguuguuaaguaauaguguugcacaguguucaugugccuaggcaggaucuacaaggaugugcauaggaaucaagugucuggacucacucagaaugcaauugcagugggacauacagcauauguaucuuuauuuguacuuauuuacuaacauucuguauccaaaccuaucaggacccuccugucucugccuuccaccucaucagugcuuggguuauagguaugcaccaccacacacacuuuuuaauguaaguucugaggaaccagacucauguccuauuuccuacaaggcaaacuucacuaacuuagcuaucuuugagcuuagauuuccuuuuaugaauuugaugagugagaggauccuaguuguucuuacuggggaguggugugguguuugccuuuaauuccaggacucgggaggcagaggcaggcagaucucucugaguuagaggccagcuucgucgacagagugagcuccaauacaguuaggguuacacagagaaacccucuugaaaaacaaacaaaaccaacuaaccaaccaaagauuucccugaaagugucaucugcaaugcucaccccucugagugaugggggguggucugcuuccauccucaguacacacuggcgucuggugcucuguccugccuugucuccaugguuacagaguuaggaacuugcugguggugaagaucccacuuacucauccugcacuguacuguugugauguguggccgucagguuugagaauuaacccgucaaacucugcuaaggacuuccugaaggcaugagguugccacacaccuuuuugaaaguugguaucucugagccuuccaguauguggaaaucguaugaacaucaucauucuugcuuucuaguuuugaugccaaaaguacauuaaagauuuggagucaaccagcgugguuggaacuuaguucugguguuuauuguucccagcuucaggcuccagaggcuuagcauugacagaaucaaguuaaucucgauugauuuauuaaucuauuauuauaagucccauccuacaaaguuguggaguguucguuuuuucaguugaugacccuguaguguuauuuguuggcaguaaaggaguugagcuuguuaguuuagcagguucacccacauguauacgggcagagaacuugggcccugauaugucugugaccuuucauuuggaauucuuccaaucuuacuauaugcuugaaauuuccauaauuaaauuuugaggcagagguauuuaugaaaaguaguguuugaaaggauuuuugcuuuuguugucucuuucccugugugaauacacaguaaaaacaaguucagucgacaaugagacuguagaauuccuagcauacacauguauucuuuucccccacauagucaaaauuucuuuuaaaggcuugaaaauauucagaguaaucaaauuucuuaauacauagcacaguuuugaagucuagacaauuauauaauccuaaauaauacauuauauuucaacauuuuacuuuaaggaguagguauauaacuagguucuacuuuguguguguguauauuacaccacuuucauauauauauauauauauauauauauauuacaauaauuucuauuauuauuauuguuuuuugaaacagguuuucucuguauagugcuggauauucuagaacuuucuauaaaccaggguggccucaaacucagacacccaccugccucugucuccugagugucaagacuagaggccugcgucaccacacccacaccuucugcacaccucuccaucuacccucuggccaggcgaugccuucugaacagcaaauccauuaccauaacgugaacagugaugugaacugucuaaucagcacaagccaucuauauuguaguuuccuaacuaucuacaauuuuuuguuuugcuuuguuuugcuuuguuuuucgagacaggguuucuuuguauagccuuggcuggaacucacucuguaggccaggcuggccucgaacucagaaaucccccugucucugccucccaagugcugggauuaaaggugugcgccaccacugcccgacaggacagcuaucuacaauuuuaacuuucugcugauauaaacaaaaaaucucaagcagccaaaagauauaguuagaagaaaaugcaaggccauuuaacuaaagcuuuuguuucuuaagcuguaaguaguguaaguaguguugggucauaguuaaugaggugcacauucaggcuauaccagcuuagauuuucucuagaacauaggacuacccuaaaaacaaaucugccagagauuguaguacaugcugaauaucacccagcacuuggugacagaggcagguagaucuuuuaugaguuuaaggccuggucuacaaagcgaguuucaggcuagccagggcuauacaagagagacccugcaugggggacagauauggagauauauuaauuaauuaauugacuaaguauaaguagccaaauauucguacucauaguugauuauugaguaguuucccuaaggggaaaacaagcauuuuauguuuuuuuaagaaacugauaugguauagaugaaugguggcuguuuguucauuuuaauucauagaaagccuauaaaugaacuuuauuguguuuuuccuaaaguugcugguauuauuuaauacauuuacaguuacuaagauacuuaaguugggugaucacuuuuuauaucugcagaucuguguaugugcuguguauacuaugccugauuuggcagaucagccuuagauauuugcccgugugcauauuaauguucuugcaaguguuacuacacaguacuguuauauaaaaagauguuuuaccugugagucuguuugauggaaagcgugggcagccucuguccaucuagacugcugcuuuucagcaguuaaagucuauauauauuguuuuggguuugucuuagaagagcuuuuuauagaguagggcagaacuuuccguaucucccacgggucucauuuuaucuuguuaagugauuauaaguacuugcuaaauuaauuaagccaagacaccuacuauguccuucaaaauaacugcugguucaaaggcucccuaguaauucagauguguacauucauuugucaaggagcgguggaaugaauggaaaauucucaaaauucaguaaguccuuguuaucugucuacuuuuuucugucaucaaacagggucaagcuagagguagacauaguuuuagaagccucagcagauaggcagcccuucacucccaucuccuuccccuguccuaggcuucuacuacuccugcuagauaaacauuuucuguaucauuuuauacagauacaugauugugcaugagaguaccacgaaaucguuaaggagccauauaaauguccucuuaguuuuuuaaaggagaaguuuuacuuugucugaaaagcagugauauuuuaaacauuuuuagcuucacauauaaaaauuuuacaagccuuucucaguuuguauauagaauuagcucaaguuucaucauggucuuaauguggaaugucuuuucuguuauuguguuaguaaaggaaucaauuuuaaauagagaaaaaaguucuaaggaaagaaacuugcauucugauacuugugucucugaaaauacuuugaacagucuccuagugccuuacuugauuuuauucuggugccucuucaaguacggauuauacuuguacuuucaggaauacagccuagcauucuggauggcaguuugugcauugcagcauuauuuaucuauuuuuguaaaggguugcuaaucgccuggugccucccugucugaguugugugcuugucugucuacgugaaaucacuugauaggcucucucaucuccaacaauguugccuguauuuuuaguucaccacccuggcugaaagugaaauaauuuaauagaaacauuuagagaucagcagcuuacuuugaauaaggcugauauuaagcggaccuuuuuuagaauaggucuguguuuaaaaaccugugacaguauaguuaugaaauauaauucauuuauccuaccuuuggcuaggacauauacacagccucucuuuaacuguuucuaagcaugggcuuuuguuuaaaagaaagauuaguguguccaugguuuuuuuuuuuuuuuuuuuuuuuuuuuucuuuuuuuguuggcaggauuuuacucuguaucccaggcugguuucaaacccacagugauucuccugccucagucuccugaaagcuguggcuucaggcaugaaacagcacacccuauuuacccagucuaucccuguauuuagauuugaaguccuacaggcucuugacauugaggaggcuuccuaaagccccuugagcuguucugcacaggaauugggaacuggagcucacaucugaaaucugagacggugaccucuagugcaguguuacuucugagccaaccccugcuguuuccuaagaauagccuuucuccagcagugggucagcaccccagauacacuuguugcucgcucuugcuggguucugaauggauaugagggggugagaggagguagagaggcucagaaagguucccugacacauugaaaaugcacuaauguuugugaccuaccucucccucucccucuccccaacgugaguucugaaaguagaaagaggcuucuguugguaggugaaacugagaagaaaagaaauaccuaauaaaugugucauuucagucucauaauaagaaacuuaagccuuauaaacaaugaacugauagggaaauugagccuaaaaggaguagugcuugaggcacauaacuuuaggaugucuacaaggcauuuuuaauacauaaugcuuugauucuuugagaauuucauucaauggauuuugaguauauucguccucaccuccucccagacuaagacguuuguaaguucuuggggacagggucuugcuauguagucuaagcuagccuggaaguuacugugcaugugggucagacgaucuugaacucuuggcacacccugcaaccccagcacaugagaggugaaggcugaguugugcauccucugaccuggcaugccaucacauuggccaugaguauuuguucguauagcauuucuucagcucuaauauguauagcuuugauauuuuaccucugaaguuuaggguuuucuuaaugcugggcaugaagggccuguuucaaagucaggaggacacaaaauagagaagccuaccugauaauaucucuagugagcugagaggacuuuuaucucucugcucucuggcuaacagaaccacagaaagcuggccaauguuggcaggauuuugagacagcaaucuggaacccagguaccuuccuggagucauagcauauacuaauguguaauuuguauuucauuagcauuagcucuugauuuuugcugaauuucuuguuuagucucaucgcagcgauucagagauggaacaggacacucugccaggccuggucaggguugcauccagaucccagcacuugauacuauaaagaaaucacaaaguaacuuccuguacaagguugauaaguuaguuggucuuucagugucgcuaagugauuaaauuucacuugcuguaaucaauauagacucuacaggaagugaccugacaucuucucuacacaagggaguuggcauugacccugauggacguggagagagcauggcuaagggauuaaggacuucaugauucaucucucgaccgugcaucuuugcuucccaaaauggacuuccaagcaagcagauuguucugcuguuagcuuuagaauuuuagugagagcauuuuuucuuuuuccuauuuauuauauuuuguagauaccauuuuuaaauuuuucuaugcucuuaugauaccagugaauugucuuuaaaaugcccaugcgucugucuguugguucuuuauggaacuuaacacugaagagcucucacuccagacuucacucuugccaagcuuggugcuuccugccuguaaucuuggcaugccggaugcugagauacugccaugagaguaugagaucagcuugggcuacguagugaguuucucuuuucuuuucuuuuaauuuauuuauuuuauuuauagaaguacccuguagcugucuugaggcacaccagaagaggguaucagauccauuacagaagguugaacuaccgugugggugaugggaauugaacucaggacaucuggaagaggacucagugcucuuaaccacugagccaucuuuccagcccagaaaguagccgccgcgccccccccccccccaggaguuucuuuucuuacaaagauuuauuuauuuuacuuuauguauaugaguacacuguagcuguacagugugcugguuguucauaugguuguugagaauugaacuuuuaggaccucugcucacucugguuggucccguuugcuccaguccaaagauuuauuuauuauuauacauaguacacuguagcugucuucagaugcaccagaggaaagagucagaucucauuacagaucugauuacagaucucauuacaaccacuaugugguugcugggauuugaacucaggaccucuggaagaacagucagugcucuuacucacugagccaucucgccagcccucacagggaguuucaagacagcuggugcacagggugaacauuucucaaacucccuaucaucuuauauauguauuuauaaauauuuaauauuuaguauaaaccauuugucucauuaacuucaugguuauccuuaacuguuuagaguagugauuuacucugacuuagaauuuuuuauggcuucuuguuaguuugcuugcuugcuugcuuacuugcuugguguuuguuuguuugagacaggguuucucaguacaguccugguauuccuggaaucacuguagaccaaguucugcccuccaacucagagauccaccugcuguggccucggccuccuuagugcuggcguuaaaggcugugccauggaauuuuaaguucuacauggugagcgguaugcuggccuuauaaaaaaguguuggcucuggguugacuuaacagauuaaacuugcucuaccugcaagcagucucugguuugcuuaugaacagccaccaauauaggcuuuuggggagccaagcagaguacugacuggaaagcugaggugagggcaucuguuacagcuguuucuacaggagacaaaagucugcagauacgucucaagucaaagucaagggcaagacgcccaguggcagauaaaggauccuaugaguguuuaaaauuugggguuagccauauaacauuagaaucauguugagaugugauguagguuuuguuuuuacuguaauuuaguuuuugaaacagggacuaacuuaucccaggcuaacuucuaggguguguuguggagucuauaucuugccaggaguguugugaacuccugauccucuaugcuccaaguguaugugccccuaccccacaguagacuggagggguuuuuccuugauuggcucuguuuucaacuuuuuuuggguguucacaugaauguucugggaggucagaagacagucugcuuuggggaauggguuaucccuuccauuguggcuuuuuugaccagcccuuuucccucuugcuuucccuucuuucuuuuuugucuucuuuuaauagccucccaauuaaaccaggcuagccuuuaacuugauagacuccuuagccucccaaauguugguuuuugcaugacaucucuucugagaauguuuuuuuaaauagugucuuauguucucugaacaucacacuauugucuaagguccuuauuuucuaccuauuguauagucuuauuguacaaguaacugauguuuacuguggggguggggaguggaaaacacugcgaggugaaaagaauaaauaauuccuuaucgcauggcucauggauaucacuuggcuguguauuuucaggcuguuugaauuauagacuuuggauauuacccaguaguucuucaguaaaaggucacuguuccucucccacuagcagcucaugaguagaguacauccaaaugugaccuuguuuuuagucucacccuggaguguagguauuguuucccucaauguguauguuauguugugguuuguaacuuaguuuucauacuugcuuauguuuguuugugugugugcccacauguacacugaggcagagagauucuucacuuucaaggcuagccuggcuuaaaucugagacuaugccccgagaguuaaaaagcuggucuaguuaaagcuugugugcuuaugugccccgauguagagaacaacuuuaggagucaguucucuccuaccaagugggucaguugacucaaacuugaguuguuaaacuuggcaggagugccguugcccuaagaacugucucacuagccaguauuccuuuuaccuggcugccuaccaauguuuguguauaccauauuuugcuguugguuugcuaguggacguuugaguugucuccccaugagcuacugugaauaacacugcuuuaacaugagcgcacaagagccugagucuuuccggugggucuagaaauagauugcugaaucaugugcugauuuuguguucaguuuuaucuugaggagcuuugaaaccuucuacuuagcaguguuuuucauuucagcagugcacaaagcuagcgcuugcuucagaucuuggaagacauguaguuucuucauggcaggcauugcaaaggguguuagaacucucgcagguaggucucuuuccuuuucuuguguuggggaugaagcccagggaaucacauguuauaagcuguugcuccgcuacugaccuauaccacuauucuguuuugagcucuuaucuuccucugcgugacagacacaugaggaguugagaacgaugcagacuuuuuaggaaguucccaguagcaucuuuaccccucucccacucuccuacucgaagugcuuuuccuuccuuuaaaagugucugaugucagcggugcgguuugggcucauuacugaguaacaagccuggaaucacauuguuucuuuuuaagaaagugaaugauagacucucauccaagccaagaauguagggcuguuauguagaauauuagugaacuuucaacacuaaauuuuaaauacugauuaaugucuuccuuuugucugauguaaguuuacacacuuaguaaauuagaaagggaaaagucacuuuguaguugccuagaaucaggauauuuguucagguaaaauacuaggacccuacccaguuuacaacacaacugcaacacaauccuaccacaauugacauuauuuauaccuuucuucucugagccuucaagucagugacuaagaaaucgcacuacauucugaaacauacuaacacugcuuugcaggagacaaagaugaucuaugagguaacugaaugcuaggacuuaacaacagauuuucaaucucuauaagcaagccauuaguuuucuuuuuuaauccuacaucaaguucuugcuguccuugcagaggaccagaauugaauuccuacacccaaucuucuauaaccccagcuccaagggaucugaugcccucugcuggccucuaacaccaucagcacaugccccaugcagucacacagagacauacuacacaaauuacaaaacuauaaaaauaaauaaccugaagucacuaguuagguagagaaaacaaacaaaacguacauauaguauguaacuccucaucucuuguucccguucccauguuucagcuuuaccccucccccacacuccuaagcaagcgcuagcuuugugcauugcugaaaugaaaaacacucuaaguagaagguuucaaagcuccucaagauaaaacugaacacaaaaucagcacaugauccagcaaucaucaaaugugaucaugacaacgcaugugagcauugucccagugaucagccuuucaaccaggaaauacuuuuuuuguuuguuuuuguuuguuuuucaagauaggguuucucuauguaauaguccuagcuguccuggaacucacuuuguaaaccaagcuagccuugaacucacagagaucugaucugccccugccccuggagugcuaggauuaaagucauucacuuccacaccccgaaaaaaaauacuauuuuaauauuauuuuguuaggcucagugggagcugguuuauuagccaaaguucauaugaauugccacuuuccuacuuagugucucuucuaccauuuggggaaugcuuaaaaccuaauagacucaucugucuuagcaguuuggguggcuaaaaucuuguauuguuagcaguuaaaaugucaguguagccguaauauacaguggauguaaucccaggucuuuaguaagaugacuucccuuaaaguauguuugggagccggcaugcccaaaggccuuuauuugcaguagaugugagcuaguucccugggcuggucugcugugggcggccaccaagagcuggucagagcuaguuccuaguucccugggcuggucugcugugggcggccaccaagagcuggucagagcuuggaugggcugccuaaacuugucuuccuggcccugcucuagggccucaggguggauuccugucacagcaaaggagggugagggaggccugggucugaauugaacguccuugcuucugaccuucagucuccccucccggacugacagacauaaaaucaaaaguuaauguugccuuucaucucuaaaacaaagcuacuuuuuucuggcaugcuguaguugcauuuaaauaccauuuacucgggccuaucaguuuauuuaacuccaauacaucugugaagcagagagguccuaaucuggcuuuuuuguuguuaaaacagcaugucuagaaguagauuuaagagaauauuuaaaauuguuaggggucaaccucuuuucuuucuuuuugcuuccuuccuuugguuuuugaaacaggucugacuuuggagcccaggcuggccuggaacacuaaguagcccaggcugguuuucaguucaucacagucuuccagccucagccuccugcgugcuggagcuucacaggaugccacaucuaacucugugugugugugugugugugugucugugugugugcgcacgcgcgagugcaugcaugcaugcgugcguguguguacuuggguggauccuggagucucaaggagugcugaguggcagaccugcucuuaacaaccaagccaugcucaccaacccugguaaaucugcaaguuauugggagacuccacuuggauagacuuccugagauuuuagacuucuuggggcuggcacaaugacaguuagggaaggucuuuggagacuuuauuuggagacucaugaaucuugaauucuggcuuuuguucucagcucaugcuaugcugacucugucauuuucuguauaauaaaagggggaaaaaucaaauugugagcuugggagaaguggugucgauugauauaucauuaugaaaaacguguugauuuggaggggaaccaugugacugaagauuaggguuucugcccacacauuuuugagcacuuuaccgacaacccaggacuuugaacuccagucuuagauuuugauuucugacaauacugaaaaacuuaccauagaagaaaaguguauaaauugucucaucuuuaucagagaauuaugcuaugugucucucugagcccuugagaguucuaaacaguacguggugaguucauaaaaggauuggcuauggucucagaacuggagcuguaggagcacuaggcuggacuguauauccuugcucuagaaucaguaaagcgcauagguuucccuggacaagaguguccucuagcacgugacuguaacuaacauuccacucuuucacaguguguagguuugauaagguacagggaaccucccuagcacuaccacuagguagacgcucaacacacaagcagucuucacagccaguuucaaaaacagacuugcacguuuucuaaagucagggucucccucccuauauauccuucaccagauuccucgccggccuggaacucacaucuuuccggguccugggauuaauggugugcgcuaacacaucaacccuaagucaacuuuguagucaagucagucacuugacuucucauuagacaauucacuagucuuauauuuaagugcagauuuucacacuuuucuauuaaaaacuuguguguacaugcacgugcaugcauguguaugugugcgcgagugccugcucauguuaucugcuucucugcccauuuuagucuuccauuucacccacagccggccccauugugagauucaggguaaugguguaaucuauaaacuugaugaauacaaacauuuaaaacacauauuacauguuuaauuuaaccuggaagucacuuucaagacuugcuauuaaagaggaaaggaguugcacuguguuugggguagccugcucuggcagccugcaucucugugaacuaagcuaucucuuuaucgggcuaugguagggugcuuuucaacaguuaaaacuacuuauauuucccaauaaagauaaaaugauguacacauaggaugccagaacuauguacauaucuguguagugcaucacuauguagaucaagcuggugucaaacucgagcucuucuugccucugccucccaaguacugauauuaaauacucccacuaugcccagccuuugaggguccaccuuuacaugugugggauugaacuuggguugucaggccuguguauguuuagcccccugagccagcuuacugacuccaaaaucaagauuuugaaaagcacuaagaguuacugggcacaucuuuugauugguacuugcuuauucuuugccuugauuugcaaauugaccauguuauguuguaagcaagaacucuuuguccaggcuggagagaugcucuucuagagaugcucuuccagagguccugaguucaaaucccagcaaccacaugguggcuuaaaacuaucuguaaugagaucugaugcccucuucuggugugucugaagauagcuacaguguacuuauagauaauaaauaaacaauucuuuuuuuaggaaaaaaaaaaaaaaagaagaacucucuguucagagguuuccuacaguuacuauuuugggauucuuucugaggagacaguguaucuguguuugcuuguuuuguuuccuagcucauaguuaauucuaagcuugauguugguugaauuaauugacuagaaacuuucuuuuagguuuguuuauuauguauaucguacucugccuacauguaggucugcaugccagaggaggccaccagaucucauuauagauggugcuaagccgucaugugguugcuggggauugaucucaggaccuuugguagaacagccagugcuccuaaccucugagccaucucucucuagccucuagaaacauuuuuacugaaucuuuguguuaucacuuuauccccuaccaggugacagccaucugaaaccucuagaccuuucuaucucucuuacaccuacauuauucuuuuuccuuuaauaaaagauuuguuuuuaaauuugugugugaguauauguaugugcccacagaggccagaaaaacaacagaauucugaagaucuguaguuacagucguuucugacccagacugcuugauagauggguacugggaaacugguacuuacuaggugaacuaggcuggccuugaacucacagagauccuccugucucagccuccuggguccuggaauuaaaagugugcaccacuaugccaggcucacagccuuuuauaggagccacagguccaguggcuuuuaaauaugaaguugauucucaaaacucugggaaguaaauaaaacagucuccacuaccccuuugugaagauuaagcagguugcccaaacauacccacguaauccagauuacagucuuuguuagggcucuuugggguuuugaauuuugugugugugcacuauacuugugaauguguguucacaugugcacucuugcauguauggaggaggccagaguugacauuggaugucuuccuccauugcuuccugucucgagacagguucucacuaaguccugaucuugucuugacuggacuggcuggccacugagcucuagggaguccgucuguuucccucccucaaguauggaggucagaucuuuaugcuaguauggcaucuccccuguccccuguagcuuggguuuuaacauagagacuucuaaaaggacacacacuuguucagugguaaagcacucagacaucauaccaacaaauagaaauuaccgguaauucagugacuuguccagggugggaaggcagagugagcucugauucugcugaggauucagccauucucuguaugaggcuucuuaggggugacgguuugacuuuuacucugcuuugucucagucacaacgaucagacaacaacauggcaggacccccggaaggccaugcuuucgcaacugaacguuccugcgccugccagcccagcggugccccagacgcugaugaauucugccucaggugagcaccacccuguugggagagccacgugcaugcuguuuguauccuugucuuccuuucuacccagagccaguugaaguuaaaguagcaugcauuuagucuuaauccauugaggagacugauaauuggacaggaguuuucuaaagcucaggcuuccuguagucaugugguuguaaguuguuugguguuuuuacuuuugguuuuugacaucauauuuguuuguuguguguguguguacuuacacaauggcauaugacaacagcuuuagagagucuguucuccuaccaucacgugacacucaaggaucacacucaggucgguagacauggcagcaaagcaccuuuaccccugaacgcccccuuccccaaagcauuccugagauggucuaauguagugauggcugacccagaagccccgcuccuccugccucuaccacccugugaguuuguguuugagugcugcugucuuccguccaggaucuaugauggccuugacucaugcauuuguaauaugaauagaaagcacguaguuuauuuuaaugcuuuaaggaugagaagagcacagcuguauggcacgauugccuuagggguguuagaguccaagcuuugguauucaaaacucccuuuuuauuuguuugguuuugagaugggaucugccagaaacuagccucaaacuugccugccucugccuguuugugugccaucuugcuagauucaaacucuuuuuaaagcagauguuuguauuaccuugacagaaccuauaaggauacugugugccauaaaccacugagcaccuaccccucuuacuucuagauguagcagcaugcauugcuaaaccgucuucacugcugggugcagugaggggacccuuuaaucccgguacucaggaggcagagcucugugaguuugaggccagccuggucuacagagugauuuccagaacagccaaggcuccauagugcacgcugucucaaccaaacaaaagcaaacacaguuaugugacuacagcuuuuccuuguuugcauaaugagcaguaauccuacucacuagaggagagauggaugcuacaggaaguuaucgauucauuuaaagcccuuauguguuuaaguuucuuuucuguauaugagauuuuuuuauuugauuuuuaaauaauguuuuuaguugaaauguauagguuuugccuguauguauguaugacauaccauguacauagguggccauggagggcacaucuggaaacagcaguuagagaugguuauaagccaccgcaugggugcugggaacccauccugguuccucugcaagagcaguaggggcuuuuaaccccugagucaucucuccagccccauagaaagaaagcuuuuggcuuaaaugacagguaguaagcaaaagccucuuccuugcccccaaucaggugcagugagccuuucucuuuguugaauggguccaaggccacacacagcugccuaacuggagcuucuaacagugggcaggaaucugguagcagacuugacuggaggguuugcagaugugagaccuccuccugcccuaaccucacgccugcuuugguugaaaacaagcuuuaaaaggugauggcugaaaaugaaaguuaggguagaaugugggguugagcaaugcuaauuauaaaggugacuugcugaagaauaaggucccacagcuggcauagacuuuggcacucucagaaucuauuugauuuaaauccuagaguuuaaaaggugaaaaugacguggguauuuuucacugguaguuuuacuuugguaacuuuuuuuuucuuuaacuaccagauuucaaauaaaagucaguagcagacacuuccuuacuguggaagaugagggcagccuguguucacugaaguugguugacuccuuuuagaacacuguuuuaucacagugguucauccauuuguuuauccuuacccuuccauuuuuugguuugauucuuuugaaagaguuucuccauggagcccugacuauccaaacucacaaaguuccaccugccucugccucccuagugcugggauuaaaagugucugugaccaugcccgucaauaaaaauuauauuuugauuguuuguuauuauguaugggggagaggcuucagugugucagagcauaagguuugggguuggauucucuucugccucaggucuaagaguugagcucaaguaucaagcuugggaggcuuuaccagcugagcccuauguucuccccugcagccucccacugagagucagagguguaacagcagcugguuuucaggugauagaagucuguauuuagaacuugcuaggagcucuuaagaccccacuccuagucucuaaaccaugugauaaguggcagaggggacaaaagaggacagggugacauuggagaccagaaacuaugguuugcucauagagauuuguuucuaguaauuacacuguccuuuaaggaggacuuugugguuagacgguacagugagcuaggaagagauaggucuacagcugugcugaaacaaaggccuuaaaaauauaaucaccaacuacuucagaaggaagcuguguaaugacacaugccaggaagccaacacugcaagagcagaggcagggggauggcugcagugagaccuagugcucccuacacacacacacacacacacacacacacacacacacacacacaauuguguucaagacuccagggauaccaagucagaacuguccaggucaccuauagaauacaggaguguuuuaaauggcaagcuuuaaacuagugugugcuguaaauggucucuaaccauguaaguaguugguuauacuggauuacugugaaguaacaaaauaucuauacauuuuaauauacaguuuuaauuuuuuauuuaauuuuuuuuuauacauugaugguuuaaucaaugcaccuaaaacuuggggaucgugggagccuauuauauguggaagucuccagaauaaaacaaauuuuagccagagaccaugcuacuuggucuauucagugcugaugacacuggugguguguguggugugacuaaaucuggagguuuuuuguuuucucccaauagagaauugaguuccuggccucacccagaugugggaaagacucuuccacugaacauuguccccguguccacucccccagcccccgucuuccccuccuccacuuacacuggggcuucagcacauacauacauacucucauuugagaucaugucuuguguaucccuaccuggccuuguacuaaguagccaaagcuggcucugaacuccuucaucuucuuccucucaggugcugagaugugagcuaccauccccagcuacuucacauaaauuaaagaauauuuuaguccuucuccauguagacauuucagagugaaauaaauguuuugaaaugaaaauuagaagagcuauacaaucuuggaccaggagaucaaaacaaaucccugcucgugcccuuacccugagcugcaacccccaggaagcuuuaaucucagcuaaccuugugcccacguaaaaugaugggcauaauggucuguuaaaauuucaaucuagaggcaugugucuuugaaaggcaacccugauugggguauauggggauuuggagggaaagggguaaugauauaauuagauuaucucaaaaaacaaaagguauaaaaaagauuaauauuuuauaaacuauuuguaauuacugguagcugguuauuacuucauuuaaaguaauuuaaaacaccugucaaccaugacaaagaugaacuguuucuuugaagcuuucugugaucaaggccuuaagcuuuuuaguuaaguagugagcuuauuuucuacuuuaaucagacaguacaguguugcauauucagauaucuuuuuuccuuuugguuauuuuaagauaaaaucucaacaucguaacacuauauuaaugaguguaguacuaugcuaacaagacuguauuaguaaaaauucaagcaggaauaauauuugagugaagcccacagucagugcaauaaggaaccaauuuauuugucuuguuaguuauuccugacaucucacaaauaacucuucacaaaguuuuuaaguaaaauggcuauguuuuucuuuucauacaaggcaauucagauaaucugagaaaugacaaguugaaaugggaaaaguuuugggguguuuacaaaagaggagguaggaagacagggagggaagaagcguggucuuggggagcuacauuagcauaaacauggucaucuguaacccuuagaagugguguucagccuguauaaccaacccuuuacucugcagauggugucaggaaggucaggcauuaagacuagcucagccacauaguucagaugccauccuggauuauaugagaccuaugucgaaaggcggcagcgguggugauggugguggugguggugguguguuuguguuugggggggauuugguuugcuuuaacagccuguuuuauuuuauuuuauuuuauuuuauuuuuauuaauuuauuuuuugugcuguggaucaaacccaagacuucauuugagccaggcuuagacuuuauugcugaacuggaaacccaaccauucaugcaccuugguuaguaauuuagaacuaaccacuauucuuacauaauaaugugggucaaggauuggacuuauuguacuuauagaaccuugcucaagauuuuauucccagcacugacccccccagcucauccuguuccugcucccaacccccauucuauaagugcaaauaagcagcuugaaagaagcacaaagauuuucaaacuucuugcugaaauagaaacugucaaucacccaaagauaaaauggccagucaguuugcagauggccuuagucuccaguaccaggaauccugaagcuuguuaauccugacacuagccagcacaaagcugacuuuacucugcucagagcugcucaugcacucuggaucagggccuuugacauagcccagugcugcuacucaaguuuucuuuucuccuuuuguacauaccagaguaguuguauugaguugaauuuguaaguaacuuucuuguguuuuguuuguuuuuugaugcagauccaacugcagcaccaagcuggccucaaacuuggaauauaucuugaccuggcuucugaaugcugggguggacacugguuaauuguuuuucagugucuuuaauaaugcugcuuucucccucucuucuaccccuucuuccucucccuauuuccccuucucccccucucucguccccuuccaaaauagggggggggguguggugcacagcuugugggaaucauuuuccccuacuaugugggaccuggggaccaaacucagguuuuaguuuugacagcaggacccuauuuacuaaaccauccugcuaaucuuuuuauuuucuaaucaacaguuuuaaauuuuuguuucuugacuuacuaugugugugugaguguauauauuuguaucacuugcauacaaagaggcccuggaucccugggucuggagugggugcugggagcugagcucagccagagcuuuuagggucuaucuagccagccuugauaggauuuuauaacccagacuaggcuuggacuuuggaccuuucucccugugucccaaguaucaaggguuauaggcuggugcuagauaccuugcugcaggguuuuuguuugcuuugagaucuaacuauugcaggugagacauuuccaagcuuugaguucaaccaaagggagcacccuugaucuguccugggagcacgcaucagcaaugcuuuccauauauuuaggaguuauuugaacucugauaguuacuguuagguguaaauucugaucuuguaaaagcaacaaauguaaacuuuuguuaccuggcccuccaggggaaagagcagagcaggagcaaacucagagaacgccaggggaagcugucccuguguuaauugccauuagccaauucuccugaggaaaacaagucguuaaauauuaagacucgaagauagaaauguccauguuaaacuuauucuccaguauuuuuuguagauguuuuggaaacuuuguggaaagagauuaaauuauuugcauuugaggaccaaaugaaauccuguuuuauuuccucccucgguuaguccuaggauuuuauuuuugucuuuuccaccgauuuuuaaauccuucuggucacuauugcuccaacagcuuuugugacucauggaaggaguauuugugaaagauuuaagauguuaauuuuucaaaaauggcaucuagacuaccauauauagacaggaauguaagugaaauggauuaaauccugcaguauauuacauauuuuuuuacauaaaaaccauuuauguaagaauaaucaguggguaaaacuuuccuuugguguuaacgaaagagauuguuuuacuuugccaguuugaagucuacaugagcgcuuugagaaaacugaucuuaccaaaucacugagcuguugaauuaaguucaaaacugauacuuaaugcauaacccuaagugggacauacauaacagacccauguccucuuaagucuuguggaacaucauuuaagaugggguagaaaaacuauaagagccaaaagaauagggaggaguguugugaaaugcugcuaugcugugagcgcuguggaccugacauggcucuuaaaugcaaaagcucacacaacagccuguggcaacuugcagaagaugaagcccguucauauuccagcaugggugugaggaggggcacuggcaguuggcugcuggggaaggagucauuuuucuucauugguguggccccugagguuguccucuccaagccuguacccaugcccacucaacugggacucaagucacuuuucuuuuuuaaaaugaguaugguauuuuaccugcauguaugucuguguaacaugguaaccuuggaagccagaagaggcuaucaaucccccagaacuggguuagagaugguugugagccgucaucuggaugcuggaaacccaacccagguccucuggaagagcagccaguacccuaaaccucuaagccaucuuuccagccccuuggcgaguuagcucgugaagggaggagugcugguguggacaaggucaggaugccaugaguacagcaguguuuuuaucugagccugaguuucgugaguggcaugucccaggugcucugguauuccaugauacuaauaugugagauuugacaguugucacugcugucccuugagacuagacacugcccuuccaaagucauugauucaacaaauaccagcaaauguugccuuuucuguaacaaaaucacaacagaguuacacaggugauucccuugcugagccagcagagcaaacgcaggaagcaguagaugauggcugucgcgaagggcucaccaaggggagcagaguuucauucccacccucggccauuauucaagcccuuccugcaugccagccacugcuuaaaucacaagagcagguuauagacagacacauuauauuuuccuguuguuaaaacggcaaaggggaggauaacuaguuacaaccuuaagugaugaagggcuggagggagauagccucucguggauuuuucuguagcuccuguagccgugggccuagguagacucaagggggagccccccaucuaugcggaggaaagggaaagaauccaagcaggguaugguuuucccauugagccauaugcugggaaaacagugacgucaacuggaggagccagucaaaguuagcaaggaggccauuuggagucauggaggauggcaggguguaaguagugaaugggagaaggagugcuugauuuuggaccuggugaacaguuuagugagagggaaggaaagguagguuaguugugagagcaccugcugagaccugaaacacagcagaguccaggaacagacagaagacacgucacaauaccugggaggaguuuggagucuucugaacauucugagaauuccauuaaaaccaaacaaacacgacucuuggcuggagagaugacucaguggaccagagugguugcuuuucuagaagcaggaccacuuuguucuagagcaccuacaauaagcauucuguguggagcuuucuuccuuauuuaggcguguucaucuacauucugaagauaaaaggaaccaucacuguuaaggagcuugcccaagauuagaagguuaauaaauguuuagccaagaauaggccaaguuguaagcucaagauauaggacacuggaaagcagcaggauuccaccuugagcuuucaguaugugguccacgugcuugucucucacugccauuggcagucuagaagggugcugaggcacaccaagcaaggccucagugacauuugagagucauggggguagggugggguucugauaauacauugggcacuuggguucaucaguuuguuugugauuguuuuagauucaaacaucuaagcuugugcagaaaaaugauacuacagaaauugaggcaaaaggauuuuaugcucgcucgcucucucccucccucucuucccccccuccuccccccuccacauucugaauaugggagagggacuuaguauuaacuugugcaaugcuuuaaaggggaaguggucuauauaacccauaaugucugagauguuuucaaguuucagaaagaaauuuaaaaaaugagcagagcagcuuugacugcuguuggucaaguuugcaguguucuagagaacucgacuggcuuugagucccaagucugccacuuucugacuuaggugguagauaauuguuucuagguugugagcuuuuuaauugaguuaauaguugcuugcaaagagugcagaacugccugcuguguagugacagcagcauauacucauuugaaauuggccuagauuuuagagccacuuccuccuggaaguacuuucuaaggcaguuacuaugcccaggaugugugcggccagccucucauuguccucugcgauuucugacucaggcaggugaggaggggcuggucuaacacagggucggugaagacuuugcuguuggguagaaaugcaaauaguuuuccugaauuauuaccaaggcaagaccacacaggcaggaacaggagguugagucuccuguguugcagucuauuuuaucuuaaguuguuuaaaauacuucaagaaguuagauuuuguucuagaagauaauuauagaucaaauaauauuggcaaauucuguauaaaauuguauuuuccugaggauaaaucuaaauuuuaaauuauuuuuaaucguuuuucuuguuuauucuaauucugccuuuuuuuaaacccucuucuuucaucucauuuaaaauauuggucucguucuccaucuucuuuucccuucaauauuuaucgucucaccuaaaugacuuugguaugaggaaucaggcauggucgucuaguuuugaaaacaacaucaucuuuucuacacccaauggaccaaacuccccuucaggaccacgucuacugaaguccagauuguauuguuuuccugaauuuuuuuaguuacagaucuuuauuuucaucugugaacacguuggcugacugacacucuuggacauguuuuggcuaggugagcaccugaccucagggcuguagccgagcaucauaccuaccuguuuauaauucagccuguguccacacaacguucuaguucuacacagcacaugugagagacagagauaaauagguaguuuuuucugcuuuaaaguuacauuuugauauggagugcacauaaggcuguuaucuuuaagguaaauacaugguuucauuuguaauuaauugauaaggggagagaaaaugcaauuccaacuuaucuugcacccucauucacaucuguaacucucuuucaagguuuucauucaacuuuugaaugguagacugauauuaguagaaaacuuucugaacuaauguuuguuuucuuuuccuuuuuuuuuucuuaaauauucauuuauuauaugugaguauuacuguagcugucuucagacacuccagaagagggcgucagauuuuguuacgaaugguugugagccaccaugugguuucugggauuugaacugaggaccuucagaagagcagucggugcucuuaaccgcagagccaucucuccagcccauguuuguuuucaaaacuagaaaucaaacccaggaucuaacauguacugcgcaagaucucacccauuggcuuauauugcuuacccucuaaaauuguuuuaaagauaagguucacuaaauuagugcuggcuuugaauuugugguugugugaaguggccucagucuccugaaucauugagauugcauguguguagggacuauaccugacuugcacuuaguucuuguaaagcuaccauucuuagugaaauuaacaaugagcaaaagcuugacaguuucuuguaaucuaggaaugcagacaagaguuugggcuagcagauuuauagugccaggaagcagaaauggaaacagaaguggaacaugaauucagacuacccugggcacaccugauuguucaucuguguggggacaaggugaaaucauugugugguuuuaaaaguggaaaugaacggucacugccuguugcuucccuugggcugauggguucucagacgagcuaaacagaacauuagugcagucuuuaggguggacucugagcacagaggccaggauggagcugcugguucuucuggcugauggcugauggcgggaugguggccagaggucaggugagcaagcacuaagaaaucaccgugugucucagucacucagugucucaggacucugaccuuuuaaaagguauuuucaaaaauaccuccggagugagccgccuucuugguuagagguuugguuggucugugugucucgugggugaugugggugcuucuuccacccaucauuuucauucugggcucuuuccauucgauacuucgcagacacuuccuuacuucuaugaaaauaggacauucuuuuuaccucacaguaggugucaccuuucaaaaacucucuguccugccagcacacucacaauuucagcuauaauccucucgugcuagcagacuuuguaguccaguacuuggaguugaaucuauagucuggguuucuuggugugagguagucccguaaauaauggaccguggcugucagcuaaagugugcuuuuagucugaccacuuaaaguucucaccugugccuuuggggaugccaauuucacuacugauuugauuuucacaaugauuugauuuuccugguggauaaucaguuagguggcccugccuuauuuucucuuacauaggcuguaaucugucuuaaugcacugcuuuuuaucugauugugucuguucuuuuuuaaaggagcaccucucaacuuuuugaggugcaccagaucaaaaccaacuagucugauuucuguuuuguaggaccucuuccugauggaugggagcaagccaugacucaggauggagaaguuuacuacauaaaccauaagaacaagaccacauccuggcuggacccaaggcuggacccucguuuugguaaagguuuacucagaaccuuugugguuauuuugauguuagugugggggcuagggagacuuaagaaaacuuaaaaaaacaaaacagaaucugcaacaccuuuaguagcaaaugcuguauacccaacuucuuuccuugcuggguuuuugcuguuuuuuguuuaaguguuucauuuuuuuaaaccuaagaaaucuagguccaaauuagcauuccagccugagccuggguggugaauucaguaaagcuccaggccggagucauugcuucauucauguggugaucuuguuggaaacaugcccgcuguguucuacaaacuggaacugaguuuguuuuccccagagaugugcaugcgugcuccgugugcugcaccaucagggcugaagguagagaaaggcucugagcaagagaacaggccuaaggaaagcgguuuacaauugguggggcuuuuuaacauaguuuuacauuaaggucuuuuccuucacucuuuacuuaggaaaugggaagcaaagcagaggccuccucccaaugugcucggguagcuaagggucuccauucccacucgcggccuuuuuguccuguuuguaguuucaucuguuggcuuucugaacuuuuccuugcaaagcauggaaaauggagcucaaaaggaacauauaaugugguuugagcacucgucucggccccgccuggugcugcuuaauggaaacaaugugcggaccagugaacgggucagacucggaccugagcagucagacaccguguggagccuuugaagcuucccgggggcugaccugaccacgccacgggcuuuacuggaaaggagaguuaacucugugaaugccacuaaaacacaacgcugaggccgaguaaaaauaacuuccccggagagagacuuagagccucagauacaauccuccagugccaucuguuuacuuggaaacagacagcacaacaauaaaaagcaguguuuggauuuaccucaaaugucagcuuuauuggcuaguuaagugccccccucccccucgcgcccuucaccccuuccuccagaaaaaucaaaggugggguuguagccuaggccaucauauuugacagauaguguuugugcuucaagacccauugugguguuaagaaagcaacauacauguuagcaguuugcaacuucaaauucuguuaauacuugaauaaaccuuugugguucaagcaggacacuuugagguaggaaauccuuaaaugcugcacuagugucaaacggaaugauaagagccacauuuccuuaaagcauauuugaugauucaguucaucugcccuuggaaagcuuggaagaauugugcuguaccacucccuguaacuuuuaacuguguaugugugugcccgugguguguguguuguuuuuaagagagagagaaagaagaaagugggaaaagcauuagcagugaagagaaucuuggcuguggacuuaguuuuaucuguugaucauaccuacagcuggguuuuuaaggaaagaguggguauuuuggggugggaaaaaaaauauacgcgcgcgcgcacacacacacacacacacacacacacacacacacacacacacaccccagcacaugcaagugacagagaucccgacuaagguccccuccucccugccaucccuuccccuucucgggccuacuguguauguguauuccagacaggcuugacugcaugccagagccuuuuauuuuguggcccgguuuguaaucuguuccagaccuuuucagucagagcuggaguguaacugagggggcggggagaagaacuuagugggcuucucugauguagaguaacagcagagagaagcaagcuguuagcugcuggaguucacucuugccuugaaacccaaaguuugcuguaauggguaguguuuuaucucugccaaagaaauauaaacugcccccucucguuucugacccuggggccaugcagauacaagcacauggugucagcuauugcuuccaugcauguggaguuugcuucucuguguucuccagauccauaguaagacaacgacuaagucuuagcuagccaaacagaaaggcagaaaggucuuucagucuuuuaggauggaggagaagcuauaauguauugcccgcuucaaauagcaacuucccacuuauuuagauuugugugugguguguguguuuuuuacaucuuguuuuuuaugcaugguuagcauaugcuugugaaagaugagucucugucaauguuaaugcugguugcuacaagaggcugguggcuuuuuaacugcauuaaagaauaugggucuuguuguauuugugccgauauuaaauuaugucauauuuuaggcuagggauauagauggcucagugaguaaagcacuuuuaguucaaacaugaggaaucugugcuuguguuuuuguuuugugucagauaggucuugcugugcaccccugucuggccuggaaaucauuauguagacuaggcuggccucaaagagaucucugauuuuugccuccugaaugcugggguuaaaaguaucccccccccccccacccacccccuuuuuuuuaaaugaauugauuauuuuuacuucacauauaugacaguuuugcccuucugcauaucugugcacugugugagauaucaagcauaggaaaaaggaaagaaacaucugcaucuggacccuugcgugcaguuaacaacuggaugcugagggcucugguuuucagaggccagccacauaaggccuacuguggccuuuugggcacagcuggggcuuacuuugaagaggagccaggcucuguuauguuaaucuuucaucuagcgauaagcccuaucuccaggaaaaguccuggcaaauggcuggugaggaugaggggugcugcugguggagcagagcagacuauacugguguccuuagcaggguuggccccacugccuaaaggugaacuugucacagaccugccuuuuucuacauuuagaacuuacaugagaccaccaugacacaacaacugccauaaguaaguccugucaaucucccagcccuucuuuaccuuaagcauuucuugacaugaguacuuugauacauaagauuauuaaauauccaagggggcuggugagauggcucagcggguaagaacacugacugcucuuccaaagguccugaguucaaaucccagcauccacaugguggcucaaaaccauccguaaagagaucugacucccucuucuggagugucugaagacagcuacaguguacuuacauauaauaaauuaauuaauuaaaaaaaaagauuauuaaauauccaaauaguucugggggccagcaagauggcucauuguuaaaggagcuuaccugccuuggugaccugaguucaaucccuaugacccacgugguagaaggagagaacugacuccuuuuaaguuggcaggcaguuugcuuauauucccccacccccaguaaauaauguuucaaaaagaaaaagguugaguuucagauucugauugcaucaacuuuaaacagugcugaagaugggcuaguuacugcuuaaagacucaaagaagucgcaaauuugggggguccgacuagggugcucucaaacguuagucuuacugcuugucauuuuccuuugugacccugaccccaggucaccucagaaugucagcccguacacucuagucugucccucagcagcaugucaccagcucaggacaggacuaguuauuuaccgugucccacagugaaggaauaguaaggugaagaaacaggacaggggaaaauaaaaggaaaggagccgcaggccaggguguguguguggggggggggggggcgggcaggcagagguuggcuguggugaaaggcaccauagcaaugcaucaaguggaaaucagagauaagcccaugugguggggaaucugcuaugagucuaacacgugcucuaauccacugagugucugucacugucugacccuuucuuccaaauaagacugucaaccucauuuccauaguuagggagaaacgugacguggcagcuguggguagaaagcugaagaccaguuagaacacacccucuaucucaucccaguucccaucuccuucuccagagugcagaaggaggugcuaaggggagggcucuucuuucaaauaugucugucugucugucugugaggccuauucucaggacacuacccuagccucagucuccuguguacuggaucacacaggugugcacugagauauucggcuuuguuggcuucuuuuucuuuuuguuccauccgaaucgugcugcuggggggaaaggucagccuuuugaagguuggaggggauauggauugaauuacuuaauuguuguccguauucuaaucaguuaaggauaggaauacuugccugaguguagugggccuuuaacccuagcacuugggaggcagguggauugccagcuugguucacaucaguauagcuggccuuucaaaauaacacugucucgaugcuacuucaguuaucuuaguuaaaagaaaaucacuacugacuuagauguaugguuuacuaaguguuggcaagccagcuauacauugauaauaaccuuaguuaagggcaugauucaccuaccuucccgcccuccagcucuuugaggcaggaucucacuguguagcccagacuggccucuauuuucagacauguaccaccaccugcuguggauccugaucccuucuaugccacagauuuccauagugagaaauaccaguauuauaaaaugccagaugggcagauuaauuacugugccaacuuacugcaauuuuuuuguagcugauucagccccuuauaucauguuaacagccagcccugagcguuuuguacuuuaaaaucaacaaaaaaauuucuuucuucuguaguuuuagaaggucauuccuucaacaagcauaaaugccuuuuuuuuccucaaaagaauuaauguagauuaauguuuuuguuacaaaaaauucacgcuuuaaauuuuauacuuacuaaaguuacuagaaauuaaugauccugcagcuaagacgagcgccucuguaauucuuuuuuauuuuuguuuuuuuugagacaggguuucucuguguagcccuggcugucuuggaacucacucuguagaccaggcuggcuucaaacucagaaauucgccugugucugcugcccaagugcugggauuaaaggcaugcgccaccacugcccagcacuguaauuuauaguaguagucuaugguuuugagaguuuauaaaccugauuuuauaaaccuaaaaguuaaauuuguaucacauuuuuauccagugcaugcuugaucagaggacaacuucggaagucaguucuuuccuuccaccaugugguccuccaggauugacuucaggucgccuggcuccccacuugccccuuaaaagugaccuuaagucugaaaacucauagccuaaggagacuuguggagagcccuggcccuuuaucgacagucguggguaguuugguuugcugucagacagauugaaaugcaguuaggggcaguuacccuuugccgugcaaguagcucagacaggauuuuagcggggaguguguaugugguguuuuuguucacguuuuuguuuuugacauuuucucuuugccuauuuuugaguugauuaaaacuggagguggguguaggugguucaggagcuguuuuucagggaagaaauuugaagagcuucucugucugucucucacugcuccgcccccucucccuggaaacaaaguguguugugucuucuuugcugcuuguggggucccugcugcgccccgugugaguauacuggugucuccugugucuuguuguccaagauguccaggaggugagugagcuguguccagacagcacugcgaggugagcgcaugagagggcgcccacccccacuccgucacacgaccaucucaguuugcuguguccugccugggcuuuugauguccugucucuucugcuuuuggugucuuucugcuuuuggugucuuucgagagucagcuaagcuuaguucugaagauccaugcugaccaauccagcuuuaguugcgugcugcagucagcagugagggucacuguugugguacugauucuguuuagagcggucuucuagaaguuggugguaagaaacagggguauauuuauuuuuagcuuuuuuuuuuuaaugcagcuuugcuauuguucaguuugcuguaguuuucuuggccugguuguauuuugcuugguuggagacaggguuacauucucuagaagagcuggccugucacucacuacaacuccagcuuaccuucugucucuggugauccuucugccucagcuuccccagugcugggacugcagaaacaaaacaccauucccagcccagucuguugucaccaagugugcuuuauaguaacguaaucuauuaucaccaacaguaauaaaaaaaaaaaaguguaaaaaacuuggucauuuucuauauuuuaauacaugaaaugcuuaugggguuuagguucuguuuugaugcuugucauauuucauaaucccagaacuucucaaaaaugaaaggucauuuucuagcacuauucaucuauuuauugaauaguuuuuagguucuaauaguauuuuuuguuuugucugcauauaugucagugugccacauguguccugugccuauggaggccagaaaaggggcaauggcccccuggaacuggaaauacagaugguugcgaagcacgguguggaugcugggaaucaagcgugguccucuggaggaguggaaggcgcucauccugugucaccugccgaaccauuuguucucuuucaauuaauuacaacuaaagacacuuuucuuuccagugggcauuugcucuuggccucagcuuuuuuuuuuuuaagauuuauuuauuauuauauguaaguacacuguagcugucuucaugcaccagaagaggggaucagaucucauuacagaugguuguaagccaccaugugguugcugggauuugaacucaggaccuucagaagagcagucagcuuuuaaaaguaauuuuuaagauuauauauauucauucguauauaagagugucucuugguguacacacacacacagccaugauauaaaaauauguaguuuguucaaaacagaaucugaacaauguccacaggaagcaucagacucaaaucuaaauguuuuaauaagauaguucuuuagucugauucacgacuugaacauauuguuuaggacgaguuggcuccacaacaucaucuucaggcuggcaguaagucuguguauuguacccaguguguagccuggugauacuuaagcaccauucuggcugguggaagccucuaugaguuuugucccagugcuauaaugacagggaccugaggaaaggguguucccacucaacucaccuugucccugcagauuucagucaaaccugugauuaggucccugggaaacgguauucccagcuaaacucauggauagccacugucaaugcagugcucuccuucuugucacuccuacuuacagcucaagguuuuauguagcuuguuucucuuauaaaaagcacugguuguucuuacagcauccacaggugaccugaaaccaucuauaacuccaguuccaggggauccaacaacuacuucugaccucugagggcaccagacacacaaguagugcacagauauacuuaauuuaauaauuaauugaaagagaacaagugguucggcaggugacacaggaugagcgccuuccacuccuccagaggaccacgcuugauucccagcauccacaccgugcuucgcaaccaucuguauuuccaguuccagggggccauugccccuuuucuggccuccauaggcacaggacacauguggcacacugacauauaugcagacaaaacaaaaaauacuauuagaaccuaaaaacuauucaauaaauagaugaauagugcuagaaaaugaccuuucauuuuugagaaguucugggauuaugaaauaugacaagcaucaaaacagaaccuaaaccccauaagcauuucauguauuaaaauauagaaaaugaccaaguuuuuuacacuuuuuuuuuuuauuacuguuggugauaauagauuacguuacuauaaagcacacuuggugacaacagacugggcugggaaugguguuuuguuucugcagucccagcacuggggaagcugaggcagaaggaucaccagagacagaagguaagcuggaguuguagugagugacaggccagcucuucuagagaauguaacccugucuccaaccaagcaaaauacaaccaggccaagaaaacuacagcaaacugaacaauagcaaagcugcuugcagguucucuuggaaagugcacgcuccagguccccauagcacauucacuauggaaauacauuaacaaucaggguugguuaucuuguuggucaaguucucagaaaguggucuuugaacuguugauucagucauauccuuuguuuuaaugacugugguuugguugugagggcguuccuccccgcagggucuauaugaaggucucucucuuucugugaaaccuagauuauguaacccaccagcuuccgggagauccccuacuucugccuuacagcgggagugcugggauuguacaugugggucauccgggcuggagagauggcucagugguuaagagcacuggcugcucuuccagagguucugaguucaaaucccagcaaccacaugguggcucacaaccaucuguaauggaaucugaugcccucaucuggggugugagacaguuacacuguacucuacauacauacauacauacauacauacauacauacaugcauacuuaaaaaaaauagaugugggccaucaaauugugcuuaucuguggccucuguugauuaaacucauguuauagggcuuagguggcaaguaccuuuauccacugaguaucuugcuggcucuuuaaucuauuuguacaacuugccgcuuugauuccuguucucugaugcuacacaaguuccauuugccuuaggcuucuguaacaguuguggcagccaugagucacagccaucacuuuuauggugccuucucaucuaucccccuugcaugcucgagugauccuuuucuagucucugaggacagucuuuguuucauuucagccaugaaccagaggaucacucagagugcuccagugaagcagcccccacccuuggcuccccagagcccacagggaggcguccuggguggaggcaguuccaaccagcagcagcaaauacagcugcagcaguuacagauggagaaggagagacugcgguugaaacaacaggaauuauuucggcaggugagaccacagguuagagugcagccuuugucuucugggcuuuccgucccacaagucuguguuucucauuuuagcuucaaucagcuaccaaggaaugucugguuugugaaaguaggcucugucugccugucuuugucccguuccuugacuagccuuggcucacaugcucuguaauucauugcccuacaucauaaagagcuauuagccagagugguggugcacaccucucccucucauccagaauuugggaggccauugcaaaaagaucaggagcucaggaccagccugagcuacauuguaaugugagggcuagccugagcuacaugacaauuucaaaaagaaaagagaaaagcaccugugcacugggcauugcaguuaagaaggaacgcuucuucccaggugugaguggguuacagacauugguucugagagcuucacaauggaggaauccugggccaucccuuggagaaaaaguuuccaccuuaaaugaauuauuuaauuauuuguagaguauacuguuaaacauuguuguuuuuuuuuuuuuuuuaaugacaaaugcuucaguauugcuacgucaaagaauuucauuuaaaacauuauacagauuauccccgaguuuauaagauccugugucuuagauucguuugguguguuuuuucacguugaggggcaggaggaccugacagugaagaacuugagaccaguucccucaaaaaacaauguuggucauuaggcugaauaagaagaaaugauuucaagaaagguuugggacugagcuguagucuaguaagagagauuuuccuagcauguguggguccuggguucaggaaaucccuagccccacccaauuauuuuauuuaucuucaaguauuuaagauauuguuaugauaguaggaaguuggucuuugguuaaguaguagaucuuuucaaauuuguauagaaacuguuugaaugaaugguaccguauuacaguggucaagaguguacaaaaggagaggacccaggaaauacaaucuccuucccccagagacucuaguuuuguuuugguuguaaaauaacaaaguuucuuuccucacccccuaagauguugaccaacacaauaguuucuguacuuccuaaauugccuuuucuaaaaucagagcuacugugaauauuuaaaauuaguuuuacauuacacuucuguuccuagaauguugaccuuaaagaaagauuaacuuaagccguggaaucucagacagacuccuccuacuuaagcuauuggugcucauuuauaaugugcccccgugauccagguguguugacaagguuagugccagcagacgauugucuugaaagacacuuacaaucgcugcacagggaaagcacacuaacacagguguuccucccuccaucucucacucugcagagggaaggguacuucccaguuauauaaaacaccaagaacaggcgcauucacaaguuccaaggaauaaaaauaagaaagcccgauucguugucuuuauucuguugugaccaugugacugauugguguguguacagugcaauuucauaugcaugugggcugccaaaaaucaagguucuuaacagaauaagaaacucccuuacuguccucacauuguuaaccuggagaugcaccucugucacugucacgucagcuaaccaggguuuccugggccgauucugcuccuuguaaacugcuuccuuccacagaagcucucuggccguucuugggugcugggcucugaacagagcggccuuccuuccuuagacguggccucugcugcuuuuucuggccguucuugggugcuggguucugaacagggaggccuuccuuccuuagacguggccucugcugcuuuuucuggccguucuugggugggggguucugaacagagaggccuuccuuccuuagagggggccucugcugcuuuuucucugcugccuacuguggcaucucacccguuguugaaaagucagacuccucugugcugaugcuaauggacugcauuuuaauuuagaacuguuuguuuagcaaucuguaaauuggguacaucuuaagaucucuggcuuccugugaacgucuuccauccacagcugugucuuauuacugaaacauugaaaaucauuucucccagcucccucuaacacagaaacaaagccuaccugacuguuacuaaguuugccuuugccuuggcaucaagucuugcugucucuccucagugcugcuggacugugaggggcaguguguucuguggugacuuaacugguccuauccuccuucgccugcuguuucuuggguagcuugggaauucugugcuauggugagaugucuggauacaauuuauaagucagccuacacagccaaaccauguggcuuaaaguaauuuuuauccgucuuauuuuuuacucuuaggcaauacggaauaucaaucccagcacagcaaaugcuccaaaaugucagguaggcucuuauaugauguuuuagcauuggggaaaaagauaacuaaauuaggaaagagagacaccguguuccuggcccuguucucauuggagauaagccagaauggauauguuugagucaucuuucucccaagacacguggcauuacuuuuccaggggacugacgacugucuggcugugcugauucucccaggguguauggcauuugagacucucagaacuuccuauauuauacacagugugccucgcuggucauuuugccagccuccaaaugcgcaugauuuuuguucaagcaacuuaaaauagauuuucauuucucacucucuuuaaaaacguuuuaaaagaaucagugaauugagccauagcaaagaaaguaguuaguuuauauacuugcaggcuaucuuuggaaauccuaaugaauauguuauucucaguaacccuucugaaggagggcauuguaaaugucaaagcugccuccacuugagcacuugguguuucaauucuccucggugacauacuggucacaaaagcaccagauacuacuguggcugcucuccugucugagcuaugugaauaguggcagucuagguaccaguguggauccaacauguuucugcucuaagagacucaaagaaauuuggaguugaagagagcccgugugccuuuuuuaaaugagcagaaguagcucuugcuccaccccuuugaccucucuuucuuuugggguaucacuguauuauaacccaggcuggcuucaguuuuuucuauggcuguccugccucagucucccaagugcuaauaagauugcugccacauuagcagccaaacucagacucaagagaggguuucucuguguagcccuggcuguccuggaacucacucuguagaccaggcuggccucaaacucagaaauccaccugccucugccgcccaagugcugggguuaaaggcgugcgccaccacuguccugccaaacucacacucuuuggagcuccucuaggcuaaguggagggagcacaugccaauggacuugugauaaaguuagaugucauccuuaucaagaagauaaacuguauuuuuucuuucuuuuuucaauuuuuggguuaggcugguuuuugaacccgcagaucugccugccucugcuuccacguccugggacuaaagaugccugaccugaacucuuguuuucuuuaucaugaugccuucauuuaaccagagcaccaaggaaggcagugcaaacacuagagcaaagagcacagucauucugaaggcaagggacacuaugcacagcuggcuauaaaacugcacagcacuggcucuuacacacaaagacagucuuuccuucuauuucucuaaaguagugguuucuguccgugacacucaacagacaagguaacuccuuagauuugcauucauaucauaaguccuagaagucagaaauaaaugcagagauucguucuugcucauaucugaaaccaaaucuagcaaauauagaugccuucaggucuucauuucacucuugaacagaaaaucuuuauguauuguuuugucuuaaagaaaagauuucaccaaauauauaggccaggauggccuugaacucucauggauccucugcaucagccucgaaguccagauuacagaugugugucuugccaccuggcuuagcuaggggcccaagucagugaucauccaugcacucaguauguacaaggcucuggguucaauuccuaacgcaacaguaaaguuuuuaagguguuuuaauuggagcagaugcuuuagauuuauauagucuuacaucaaaaauguuugagagagauaaauuuugaaacugccauuacccaugcuaaagauuuaaaauaccaguuuuuguggguaugguuauacagacccguggucccuguacuugggaagugagugcuggcaagugaagacuucagagccuaccuuggcugcauagcaaguucaagacuggucugggcuuacaugagacccuuucuaaaacaaaauuagcugucagcaucuggauugaugguuuugaagcugucgaucugugguggugaacucuugacauugaagcuucaggguguuuuuuuuucucuuauccuacagagauucuccacgaccuuaagacauuguauauggagagaaaagugacguuucucauaucauagaggguacagcuauugcuucuauaacaaaaaccacaacaguaggguuuccaauuuauuuaagcuguuuuucacuacccaagagccuucaaaagugguagcucagagacccagcaaaagcagauugacagugcaguugacugagcaguagaagcaguguuggcacacaucuagcacaacucagcagggccgauacgcucacccucugggcaguggggcuuagagacuuuccuugacaaggaaagagaaaaggcaauguugccugaccucaugaacccugcaggagaaugauuuuauuugcucugacucuacuuggagaaaaggaauucucaaucuggacugccuuugagggaagagagcgugcaugaggaagacaggcaggagaggaucaaaaagagacauggcuuauaagggcuuccucuguccucuucagaucagucagcuugccuaagcaccacgccugccacgguaucaaggaaggcuuugguucggugcugggcagugaguguucguucaucagguuucucuggguagcccugauuguccuagaacuccacuugccucugacucccaagugcugagaugaaagcaucacccuggcaggaagauggugagggggcuuccuacaaggcacgagagagucaagucagccacacagugcucaacagucuaggcagacaugaaagggcuaaagacgugcagacuuuguguagacaccauaguuguugcuuuuucacuucugcaguagaaagaugugucucauuuacggccauagcacagcggaugcaauugucagcagguccagagucccaagugugcauugguuuuacuuacuuacuuacuuagacagggccguggcuguguagcucuggcuguuuuggaacuuacuacuuagaccaggcuggccuuggacucuuagcagguuucaagaucucucuccugaguuacuggauuacaaauguguacaagcacugucagcauuuuuaaauaacugcagucaaaaaauguuuuuagcacuuuuaaugaggcuaacaaaucaugucuguauucuggaauccuguagcauguguguacucauucauggguuaaugaaaaccucaggcaggcaugugguaugaaucauauugacagaagaaagaccuuuugagguauuuuuaaaucuucauaacuaaauauggaacuuuucaccauaaauuauuguaucuuuauaggauugaaggaaauuguucuuauguagagcuuaaauuuucauuucuauaacccaaaagaaaccauagcuguguaaauaucugagugugaguacccacuaccuguggcaaaucuaggucucucacaaggcaguccuguacacucccaacuuuguuacaggucuggaagacacacauugaagaaguuauuaucuuucuggauacacuuugcccucuuucucuguugaaaaugggguucugagugucugaggucucucccaccuaaaaggcuggcagccuuaggcuucauggucagguuauauuacuucauauuacuucucuauauuugguaagcugcuuuucaucggugagauccuugcugguccccucuccuaccaacuaggacuuuguguucucucuaaggccaggucucauccaggaguguccucaucagaagcugaagagcccgaaacaagacaucacagaaaugucuuaucucagacuuaggagaucaaaagucagugucaaucuucauagaaaugacagugucaguguuguguggcugggugagacaauuguccuuguuccuggcacagcucagggugccucaggagugacucugugaaugagugguagcauuggaggauuugacuagcuacauguacauuaacacuugauagaaaaaagguucagcugccauauauauauauauauauauauauauauauauauauauauagguuuuucgagacaggguuucucuguguagcccuggcuguccuggaacuuacucuguagaccucuggccucaaacucagaaauccaccugccucugccuccugagugcugggauuaaaggcgugaggcaccacgcccggcugugcugcucuauauuuuuaagcaaacaauuuacgcaaaaucaaaucacuguucagaaccauguaaaaauaauugccaaagacauuucuuucuugaaaauuuaguagcaaagaauuugacuucccccaacucaaaacugucuuccaaguuaacggacaucagaaaucauaauuuacaauucuuuaacacuuucuucaacauuaucucuuuucucuuggaauuccuaauuuuucauaaauccuagguuuauuuaauuaguucagggccagccuggucuacauggugaauuccaagccauucagggcuacauaguaagacaaugguauugcagaguaguuacccuuacacccuguacacugcuaauaguuuacaucuuugauuuacuaacuaaaauucucuugaggaagugaugccauaaagagcuuucugguuuuuucuuguuuggcuuuugcuuuuuaaguucugagucaaaaaagaccaaacucuagaaaucugucagaaacagcccaauuuaauauguuuauuuuagaaauaaugaagaacuuuaugacuuaaaggugaguugcgaaaugagacaaauacgacccuggucugucuugguuuaguuuuugaaucaggguugaccuugaacuuggaucaccaccauaccuggcuaagaccuugaacaauugcagcuuauaaauuguugguuuagccgggcagugguggcccaugccuuuaaucccagcacuugggaggcaaagacaggcagauuucugaguucaaggacaaccagggcuacacagagaaacccugucugaaaaaaaccaaaaaacuaccaacaacagaauugugguccagacagcuaucaccaagacagacuguuuauacgaauauguauuuggggaguuaauuuuucauuuccuacguuuaaguuuucccuucacaaaggugacccuccuuaaacagaugauugucaacuugcccgugccuguauccuaaagcacauguuuuucacauagcucaggacugcugaagucgacugacuuggcugcacccaccguuggcuacccuuagcauuugcauaugcagcaaauaggauucaguaaaguuaaaccuguuuguugcuggcuucaagaaauugucaaaagcuagaguagugaucaguuguugaguguuuuccacauaaaugaugggggaguggauuuuugcauaaauaaugcaguuucccuggcuggcuggcuggcuggcuggcuggcuggcuggcuuucuuccuuucuuccuuccuuccuuccuuccuuccuuccuuccuuccuuccuuucuuucuuucuuucuuucuuucuuucuuucuuucuuucuuucuuuuuuuugucauauuuuguuuuuugugguccagccuggccuugcacuagaaguaguccuuuuuccucuaccccccacuaauaauuacagucacacaccuggcuuccugccuacucaccucuuucuuagucaugucuugggcauucguugagaacagcuucucuuccuauauaaaucaaccugcaugcaugugagcaccauugugcacacucacgugcacccugaacccugugucagaugucacuuggagccaagguugcuacaggguuuccuguuucuuagucugugugcauguuuuuucagcaaacaacacuaugcuacggcaugugacaguuacacuuaaugaacagaaagcauucuacauguugucagagccuuugagaaggcuuugggcaguucucaauacaugaguggaagagugggggugcacccuacuccaucagucagcuacugaaggagggugagcaugaaauuagagcugacuuuucaaaagaucaccuguaagcuguccuaucauaacgauuguugcuugggcuguagcuucauugguucagcguuugccucucuccaguuugguccucagcacagaaauccauccaugguccuuuaacugggucaguguggguagcugcuacaacuuaagccugggacauaauuggauggucuacaggagugauaucacccgaagcauuagauguugcaaguugcucugucuccaaggaacguggaauuauuucaucuugaacacagugccuaaaauuagacuacugagcuaaaaauacaagcuuguuaaacuucucuuuucccaaagguaguuggaaaaguuugaaagucuuucaaaaauggggaaguaagcaagucagaagaaauuuggccagagucaggucaggcuucugcccugugucagaggucaaauaguucuucuacuagaguauuugacuuuuucuaaaucaaguaaguauuuuuagcgcauuuucuucuguaauaauucaaacaugcaguagcuuuucccagugagccugugaaucucagcuaaucugggacauguuuagagcccugcccugugaguaaagucaguggucccagccugauggcgagggagcuuuccaugguggcugauacggaagauggcgcugccugcuuuccaggaugaaguugaguuuccugccccugacuucagugucauuuuuuacagugcauggcuggcaagugugaaguacuagauuugauccuuaauacagccuggaaagaagggaaagccauugaucuguggcuccguauuaaauaugaugucaucuuuuaaaaaugaaagauaaacacuguggcaacagucagaaauugaagaggacagagauuagacuaguucuaggguuuguaucugacuguuaaaacaaggcuguuagagccugggcuuuagggcuugaaauccuucugcuucaaccuuccgggugcuagaauuacaggugugcaucgucauggcaccuggcuuaggucuacauaggggugugugauuguauacacuaaauaaaaggguaaguaccauguguguuuguucauauaaaauuugauuuaacuaaauuguguuaagagaauggcgggggggggggguaugggggacuuuugagauagcauuggaaauguaaaugaagaaaauaccuaaauaaaauacaauaaaaaaauuaaaaaaaaagaauggcaggaagcccagaaccuucuuuucugaggacaggagagaaggcagcagcagaagaaaccaaggcugguucuauagcuagaacaauaacagacgugugugugcgaucaccugccaggugaugcuggaacaugccuuuaauaccaguacucaagaggcagagguaggugaguuuugggcuagccuggucuacagagaguuccagggcagccgggguuggggugggcaagggcugacaaacagaagaaggcguggaccugccugagucaaagcaaggaaugaacaagaagcagaugucucaaugugaauucucaaaacuauuuaaggugccgcucagucaguucuguuuuccagguuucagauuucagccaguuuaccuugccuugaguauaaugccuaucaucugugugcgcgcaggacggaugucuuaugaucuuucuugcaaaucauugccagcccugucgcccagaguacugucucuugcucuuauugaucccaucaaggucgggguagcuggauuuugaucauggcucagggacccuucugguggcuccuugggugacuaggaaugaacagcugccuucauaucucuaaguugccuuucuuggugacucuagaccgcuggaucugcggcaucugccugugggagaaacugaauuguuaaaugaguccggaagugggggcucagcaguuaggagcacugguugcaauuagaaccuggauuucccagcauccauauauauauauauauauauauauauauauauauauauauauauguauauauauauauauauauauguauauauauauauauguauauauauauguauauauauauauauauauauauguauauauauacauauauauauauauguaugguagagcauagcugucuauaacuuuaguucuagaggguccuacacccuuaaacauacaagcaaaacaccagugugcaugagauaaaaagaaauuaaaaagguagaccaguaaaagcagaagagcaucagaauucagagcagcaaaaacacagauacuuugagacaauuucucuggaacucauucuuguagaccaggcugaccugccucagccggccugccucugcuucugccucugcugagugcugaauuaaaaguacaagugcucacuacaaccuacagagggcugcuacuaguuuuaacccauucaguaaccuuggaaaaguacaaucuucaaaagagccaagauaaaauauuguuaaaauaugaagauucagcacacuacaguuauuucuauuaacuguuugucagcuauggaccaugcugcuguugacugaacagaauucaaaacaaggcaggcaaaaaauaugcgucuuugauaagaugcauucugaggugcugggauauggauauuggcaguacuugcuugccuagcacgucacagaacccuggcucaguguugcuacuguuuuggguuuuguuaauuuuuuauuuaaacaauuuuuuauuagauauuuucuucauuuacaauucaaaugcuaucccgaaagucccuuauauccucucccugcccugcuccccaacccacucauucccacuuuuucuggcccuggcauuccccuguauuggggcauauaauucgcaagaccaagggacucuccuccuaaugauggccgauuaggccaucuucugcuacauaugcagcuagagacacagcccuggggguacuggcuaguucauaucguuuuuccuccuauaggguuacagacccuucagcuucuuggguacuuucccuagcuccuccauugggggcccuguguuccaucugucucuucacccuguccuuacagggcauagguuaauaugccgugcuaagcaccacgagccugcuaucuguucagaguuuuaaagacauguccugcaaaauucaaucucaaaaugcagcugggauuguuguaggaguuaacauggaaagagcauugccuuucuugaacccuaaauaauagaaagaaaaaagaugucuuagcaagaagccacacauaggaaagccaccauuauagagucacuucuuaccuuucaggguaauguuaucagugagagaauucugucaaacagaaauggggcaucacugcaaccacgacagaaaguguuggccuuuaugcagagcaagaggaggccgcagaaacagccagaagaucuaagacugggccggauagucucaguguucuuguugaaauggcuugacccuguagagaauaugcagacagaaacugagcaagacaggcggcgugugcacgcacgcacacacacacacacacacacacacaccccaccuagaaagauaaaggucuuggacuuguagagagaggacaaaagaaaccaggaaaggcuagagcaggaagagccuggaaugugaaggguuaagugggaggugaggucauccaagaacugguucccgaagccacacauggaaaacaaacucaugagaaaguguaggggcgcacaauacuuacacauuaucuaggcagugguggcgcacaccuuuaaacccagcacuugggagucagaggcaggcagaucucuuaguuuaaggcuagccucagcuacagggugaguuucaggauaaucuggucuggaugaaacguuuaauauaugaaacauauuggucauugcgugcuuuccucauauauaccucaccacauccucuugaucucuccuuguuagucucucccaucaaauaagccaccuuuccuuuucaugccuuuguugguguauauacuuuaauugagauuuucaguaggagaagccauaugauacuugucugaguuuggcuugcuuugcacacuauguucacccccauuuccaugaguucucguucauauuucauaucacauuucuuuaucuacacaucuguugcugggccucuagaccacuuugccucagaaccuuggcuguuguaaguaaagcaacauuaaacauagaugugcaagugucucaaggaauuagguucccugugguguuuacccaggagugguucucuggucugaugguccucauugcguuuccagugcgccuuugcucuguacuaacuuacuuguccgcuagcagcacaccaggcuuccuuucucuccucucugucuuuacagcauuuguuguugguuuucuugauaguaauguggacuaguuugauccugccuuucccuacugguugaggaguauuacggaaauaugaguuacagaaauacuggugaaaaaucagcuacaacgaauauuguuauuguccauucauaauugaagaaaaucuuaaauuggaguuugaauuuaccaaaaauuuaaggugaucuuucccuccaacauccccacacaaguucauaaaccugaguccucaguacacguccagguaagaagccccagugugaaggguguuaggccagaggauguaaauaagccugaauaaaagagaggagacaccauagcagugcuguguagaguaagaaguguugcuggggggcuggugagauggcucaguggguaagagcacccgacugcucuuccgaagguccggaguucaaaucccagcaaccacaugguggcucacaaccaucuguaacaagaucugacgcccucuggagugucugaagacagcuacaguguacuuacguauaauagaaguguugcuggcuugggcccugagugaagauguggcucgaggggcuggaggaagcugugccuuaaaggcagccuugggccugggaaacugcagagagaccuggaagcaugcuuuauagaaaacuccaucuugcaagucaguuaccaagugcaaaagccugugcacaaacaagcaggggugacaucugcuuaggaaacaaacccacgauuuauaggguaggguggugagggcacuggugagagacccugguccacaaugucugaaugaagcaccucugaggccugucaucagccuguggcaggcagauuuccagguaggauucuguugagcacuguuugaucccugaagaaauguuaacccagacucgccguccccagaggagagaacacagcucuauuuaguucugggaggaagucccuaagacaguaagacuuggugugagcaguggggaguugggggacuggugucuaacagcaaaucacacauguucuuuccauucuguuuucacugcuggccccaaaccuucagagccgguaaguaauaacaaaaucuaagaauugucauuaaagcccaacugucccaagggaaaauuugggggucuuugcaaguaaagaauaguaagauggaauaaauuauauguguguuugaggguuagugucugcagguuguuuguuuguuuguuuguuuguuuguuuuuucgagacaggguuucucuguguagcccuggcuguccuggaacucacucuguugaccaggcuggcuucgaauucagaaauccgccugccucugccucccaagugcugggauuaaaggcaugcgccaccacugccuggccagcuuacuuucuucuaugcacuuaaaaugcauagaagaaauugguuauucuaauuagaaaauauuuuaaauauauguuaauguuuuaccuuuuuugugucuauuuaccccuuuugugguauuguguaucucuuuuaaaucuaacaauaaauuuguaaaucagcagacuuucucuuuacuuuuguuuguuuguuuguuuaaggaauuagcucugcgcagccaguugccuacacuggagcaggauggagggacuccgaaugcagugucuucuccugggaugucucaggaauugagaacaaugacaaccaauaguuccgaucccuuucuuaacagguuagugagaaugcuggccaguaucuggaacagacccuugcuuuguuguucugcuuugagauuuauggcuguguagaacauccgugugggccaaaacccauagcugucaaccaucucuccacaggugccaagcacagucaaagcuaaggauuaaaggggacuagcuguucaggcuugugcagggaucucggucaaagccacaacaugcuuauuucugccuguaaaaauuagucuugaaggauagagugaaugccuuuuuguaaaagcaagcagagacagcaucuuacccccaaggauguuagugaaggaugggggaaugcuaugcuccacccaaaauuuuaaaacauaacguuaguggcccuucuucacucccucagcugcugcugcuacagcucaggggugugguuccaugguguauguguuuauauuuuuuaaacaucuuaaccccuuguccccugagcugcucuggugccugccagguuauccuagaugcucaggggcgugaggggccagcauuaauuaguugggauucaguggagagcaaucuuugccaagaaaacaauaagaacuaucuguacaucacagugggcuccucugugccuucucugggacugggggugggguuugucuaaagucaccugcuuaacagacucaaaugucuguugugugucccuaugugggaacagugucccugccauucacgguagaagcuaacaggcauccugggcuaauauauacauggcuguguuauauaccaacagucucaggcaaguuuauguuucuuggauuuauaugaggcugcugaauuuuucagagucguuggcauaaaacaguguuuaucauguagagugaaggagaggacggaccaaaugcauugaacaguuaauuaggaagaagguugggaucaaacauuuguacugcugggcugggaucugguaaggguuuuguuuuuuuuaacaaacacuuuaaauguccaucaugugagagagccagucuacauuuguggucagaagccgguaagaguagcgauugcccuuggaguuguggggguuacugguuugcugguugguuuuaguauuaguagaauuuagguuuccaguugauagcagcuauuuucagucauaacuuaggaaaguauccucuucaggaagcuucaaggcuguuuucugcugcucuugaaucaaucuugagaguuugcauucagccuuaaguaacaaugcaugcugccuccuguuucuccugaaggcccucucucugcuuuaccucccuucucuucugaagcuugggccucuuagcugugcugagguguugggguguucccucccccaacagaagcaagaagaucuaguugugggaauuuuaucuccagugaguugacuauuuugucaaaaagacauucuggcucuuucuuugggcuguccauggcuuaacuugggcgucuugggagcuggaaagugagcaugagccuaaugcagguuugaccccucggccgagggacuugagaccuuggagaccccaagcuucaaaauaguuaaugggacuugucacuuucuuuucucuccaagcucagaaccuuuagauggcuuugucuuuagcagcugccacuuuaguuaggaucaguguaucuguccgauuccaguacagaggcuguugggcucugcagaggcacugcaaggcaaggauuguuggcuguuccucucaaucuuggucaugcuuaacacaucuuuauuuuugcccugaguugauugaacuuuuccgugccuucucacuguuuuccuaguggcaccuaucacucucgagaugagagcacagacagcggccucagcaugagcagcuacagcaucccucggaccccagacgacuuccucaacaguguggaugaaauggauacaggcaaguauugauucccuuucggcugcacauaaucacuaguuguguuucuccucccuuccuucuuagacagggucacaguguagcuaggacaggcuggccuggagcuuagaggcuccugaguucuaggauucaggcacaagcugacacacuggguuuuccuuugagaugagguuuuugccguggcccaugcugaccuugugacccuccugcucugcuuucagaaugcugagauuucagacacucaccaccaugcccauuguuugacccuguuuucuuuuaacauguuaguugggccuauuagaacucuuuuguuuuagaucuguguucuuaauuuuuaauacguuuuugugauccacuauuuauuucuuuucucugaauacuuuggguucagcugaguuguuuaagguauuacagggcuagcaaaccauauuugggggagggggcuuagacuuuaugguugaaauaguuguacaagcauugaggagcuaagaccuccuugccuuggcugaggagagcacagaacagggaugcauuuucuccacagugucagaagucuuucaugccggcuuuuaucugacacaugaaggugagauuuugagaacuugucgcuugcuuccucugaguuuacauagaucagaaauccuguuuaggagccacuugggccuaccucauccuagccccauccuggccccucucaccaacugucaugucucaccucuucagcccccuuguagcacuuaaggcuguuuguuuuucugaauauaaguucuggcaaaagcuccaagaagugcuaauaucauggauagauaaaagcgcucugggcaguaagugcaagaaauuuagaaagaagucuggggaggucacaugucuucaaggacuccugggaaugcuguucuucuguugccuguaugagucuguagugcuuaauguuagugucccggaguacaacuuaagacaaaaggugcugcaucuugacaugcugacuaccuagaaaugguggugcauuucuaggagaaagaaagaaggcgugguuuucauuuuucacugcugcauauuccaaggaaguuucauagccugucaguuaacacuuugugauaagcagccaggcuguauauuuauauugcaugucugugaaguggugagacgcgugagacuuggcauugcuaccaagugaucucugugugugguguucuaagguagacacugugugcuucaguugcuguggguauagcuacgcucacacaggcagcucugacacugugugcuucaguugcuauggguauagcuacgcucacacaggcagcucugacgcugugugcuucaguugcuguggguauagcuacgcucacacaggcagcucugacacugugugcuucaguugguauggguauagcuacgcucacacaggcagcucugacacugugugcuucaguugguauggguauagcuaugcucacacaggcagcucugacacugugugcuucaguugguauggguauagcuaugcucacacaggcagcucugacacugugugcuucaguugguauggguauagcuacgcucacacaggcagcucugacacugugugcuucaguugguauggguauagcuacgcucacacaggcagcucugacacugugugcuucaguugguauggguauagcuacgcucacacaggcagcucugacacugugugcuucaguugguguggguauagcuacgcucacacaggcagcucugacgcuucucacagaacauuuguucaucccuccucaaaacuaggagacaccaucagccaaagcacccugccgucacagcagagccgcuuccccgacuaccuggaagcccucccugggacaaauguggaccuuggcacacuggaaggagaugcaaugaacauagaaggggaggagcugaugcccagucugcaggaagcgcugaguuccgaaaucuuggacguggagucuguguuggcugccaccaagcuagauaaagaaagcuuucucacgugguuauagagcugcagggagccacucugagucugugagggauccacagagccuaagaugugcacgccugaaauucagauaagucaguggggguucucuggcuaacacagaaaacagaugaaccaguguccaucguuguuccgcuuuucucugcccgucgcugcucuuacguugguugcugaccucuucacggccggcucuaaagaacccgaaccgcagacagauuccuuuguuaacucugcuaugauaacuacguucucugggauugcugggggauggccugcuggauaauggauguucugccuuuuguccggugguccuuucaccaucacuuuaacugaacacacagacugggaacugaaugcucuagaacauuguucaagaggugguuucuucagcugccuuggguccaacaagccagaggcauugcgucugaucucguggaggacggaggggacccacgcugaagacuggugaacuuuccauucuucuguuagcgaugccguuaggccauagugaccugggucuuaucuuagacgcuuaugaggcaugagacagcuuccauagaaauauauuaauuauuaccacauacucuagauuagguuugaaugaauauuuucuguggguguuuugguugguuuuucucugcccccccccccuuuuuugugguuggucuugguggaacguaggcaaauuaaugaauucguuuauagcuguagcuuggggugggcaauaccauucuuuuggugggaaaucuguauuucuugguuuuuuaacauccuauuuaaaucuuaaaucuugguuaucuccucucuacauauauacacacucuuauuaugucuaugguagugugauagcagaauauaucuuuauaaacauuucuuuccuuuccaguuuauuuuuuaaaugguagccuugaacauauacauuuagacacaguaguuuauguuucacaaauacuuuaaauucugguuggagcaauugcagguguuugagggagggugggcaguguuauagaaagggcucuaguggguaaagccaagaggcgccucuugcccucugugcacuguggugacaacagaagccaacagugaguggccuuacuucccuuagccugauuucaugccauguagugucugagcuguaagcuuuagagaggcaggccugccuucugccuccaccucagcuuuggguguacacucagauacugagacugauaauccacgaggucagguugagugucaccuacaagaucaugcuuaggaaaccuccucccgugucugcugaguggacccugggguagugugcagaaugcugcgaggucauagguaaagugaucagacuagcaagugugggguaguuggacugagcagagcuacaaugaagcaugauuauggcuuuauuuuugcaagauuacuagaguaugugucuccaggaguaauaaugguuuccaaagaguauuuuuuaaaggaacaaaauaggcaugaauuaacucuguguauaagcuaugaaguaauaguugguuaugaauuauaguggcaccagcuagcaccucugucauuuaagggucuuugagugcuucuagaagaaucccuuauuuucaaggguucauaaugaacaacaauuuuccccccuggcuaaagcugcuacuauaaaauccucagcuuaggaagauagaaaucuuuuggcccuuugauuuaguauagcacaagaaugaaguagaaaaguuuuauucaguacuuugagugcucaaaaaauacaaucaguguauuauaugugauucauaggucagucauuugaggccauugacucuaaggcuuuuaauuagaaacuaguugaagacucacccuugaauuaagucuggggaaauggccucccggaggaugcagugacuguagaacagagaugaaauucuacucuaguugacaauugagcagauggaugauccacaacagugcguggggaaugggcagaugauaggcgugccgagcgccuaugauuggccagcagcugcagaauaaaggauggcgucuucugugggcagacuagcuguaguguggggagggggaggggaggugggcaugagcuguugaaagguuaccgggcuaugauauagaaaagcuuuuaugaacuuguuucucuucaguaaagacuuaucucgcucucaguaaagaaguuccuaaguuugcagcugcuuaaccucccccacaagguggaugugccgucuuccuccucccucagcauggugcgccuuguuauaccucaauguccagcagccccuggugccugacagugcucucugaccuuaucaaacccuccaugcugacugugggagauuuaagcacccugacucucacuaaauuugaaucacggccugaacguagucuuucuuguuguguccagcaguguuuaaugcuuccuggcuguaguagguagcauacagguaagaacuuaacugguuauucuugaauuucuuuuacaauaaaccaauuuuuauaaucuuaaa

SEQ ID NO: 12159 - RNA, 35841 nt, Mus musculus
auuuugggagcuucgagucaacaauaaaggaccgagggugcggagcgggaguggccucggugguaggacucgggcccgagccgcggggcguggggugaggcggcguggucggggucggcaggauccugaggguaucagggagcccccuucgggcagaagcccgaggcccaggccuggcccgggaggacgggcggguggccgcugagaagagcgggggcggcggagaggaguggaaccgaggaauguggcgugugcgggguauggaggaggagcggcggggagcucuggacgagcggugcgguagacgggagcggggacggaacaccggccgggacacccgagugagguugggagugcgaggcagggcagcccugcgggggguggcagggcugugcuggccggggacucggcugggagaggagccgcggcugcucgcuugcaaguaggccuugcagguugguggggacagaggguuugggggagacucggcggcguaagaggggaggagaggcgguccaguuucgggguucucuuccgggccuucugaggggggggagucccuauuguuucccacucgcagagcugguuccggcucuuguggcgcagauaggauugcagggcagaaacccuuuugcuuuuugauccgagggagcuggguuugaagcgagggaaguugggggagggggcgaggaauuauugccuuacgguuaccggacuccgauucuuggcuuaggguuuucccuucgccauagccccccuuuaccuucguaagaaccccaaucacuccuacuuccuguugaggcguauagaaaucgcccuguauuugcaaacaaaagcccuuguuggagcuuaugggacuguuuuaggugugaaaacugucaauugcuaaccacggucugggcccugcuguaauuaacucugccaggggcuccucccaacuaagucuuauguuccuucgugguuuuguuuuaggaauauaacuugcaaaucuaaauugggaagggguaggacgaaaaauuucccacugagccauaaagcugcagugcagguauccguuucuggagggagcaguuaucgaagucucuggguuuaaggcgcuaggagguuuuacugugcuugauugacaguacugauggugucgguuaggauucagagguugcccccuucauccucuuagugcuguacaaacaguaagccuuccuguuugacggaccugauacuguugaucguaugcugucaauacagaaaauaccuauugagauaacaaauaaacaauuuaaugugauagaagcauuugugagcaaguugauguauuuaacuugagauaucuuuugacuucuaaauuauggauuugggauacuugguuugaggcaaagauaaccaguacuaauuaagcuaguguuucgggugccagugaaauguaaggggguuacaaaauaaaacugaaggaguuggacuuauacuuacaaguccuuaguaauauuuuauuuaccaaauuuugagaauuccauuuggggaacaauuuaaaguagaggagguugaccaacucuuucuuaaaauaacuguuaauuagacgcuguauucuaggugauuugggagaauuuuauuaaaccuguaaguuuaacucucugguauuucuuucccccuuaacuacaggacuccccgcccccaccuuugaacuuuauuuugaaaaguguuguauuaaaaggcagcacuaacagcuuucaacuuuuuuuuugaaaagucuucucguuuuaagguuuuugguuucugucagaaauagaaaaaaaguuaauaacuugucuuggucaaaucuagauguacauuaaguaaauugagugauauuucaagucuuaaugcaauuaaacguaaugacuuuuaaagguggcaggacuucgaauucaucaggggcgauuggagaacagauuguuauuugagagugaauuugaauuuuaucaauaguaucuuucugccucacuuucucuaaguuucuuugaucuuggaauuuuaaauguuugagguuagauuuuuuuuuuuuuuuuuuuuuuuuuuuguagauuggguuuuuuaaggcaguucuucgaugugucuuucuuaucucaaguagugauuuggccugaguguggcuguuagugguucucuagaaggugagcauucuaaaggagcucuuuaaaagggaacaauuuucccccaacuuuguugucugcuaauuuaauuuuuucuuuguuucagauugaagugagugaauucagauauaauucaagcuuguuagagggcuuuaaaaaaaaaaguugauucggugcaugaaagcaaguuaacuacugcugcucaccguugagagacuuacaggugcuugccugaacugcaauaaaggacucauauuauugagcaggacuuauuuaucucuucauuuuggagagccucauaaacuguuauuacaguuucucuacugacuuugaaaaguuugaaguuuggaagagacaccugugcagcuaacaaagcaugagcacggccagaacagagaacccuguuaucaugggucuguccagucagaacggccagcugaggggcccugugaaggccagugcuggcccuggaggagggggcacacagccacagccacagcugaaccaguugaagaacaccagcacaaucaauaauggcacuccacagcaagcccagagcauggccgccacuauuaaguaaguggaagaagaccuuggggacccgcaguuucugguuauuucuguuguugacuacuuuaugccuuacauuaacuguuuugauugcaguuggaggauagaucauuuugucauggcccaguagguauuuguaaucaaguagugugugaccugccauuguaaucgacccagcaaauaaggaacauagacgucuauaaauuaguguguuaagaaauaaaugugcugguguuaguucaguguagaagguaauaccagguucugcgaauaaaauuaucccauucuguuugcuuuugagcaggcuuacuugguagccaaagcugaccuggaaccuguggcaaucuuccuguuuaaaucuacaaaguacuaagguuacaccugugagccaccaccuccgacacguuuguuuguuuguuuguuuuuugcuucuaguguuaccacugcaacuuacccugguuuucacaacaguuaaggaucacuugaaauuuugaaaaagaaauuuuacuuaaaauuuuuuuaaagguuuuaugugucuggacauuucaccuguauguguguuucuuuacuauaugcaugucugguguucauaaaggccagaagaguuuguugaagccacugagcuuauguuauaaaugauggggagucuuuuagugggugcugggaauugaaccugggccagcguucuuaaccaauaaaccauuucuccagccuucccuguaaaggaaaguguaaagauucaaacguuaagacaggcucuccaggcugugguggugcgugcccugguuuccagucucagggaggcagaggcagguggauccaggacagccaaggcuacacagagaaacccugucugaacuuuauuuccuucuaccccaagacagacagaggcucuuuuuuuuuuuuuuucuuuuuuuuuuuuuuuuuuuuuuuuuuuuuuguuuuuuuguuuuuugagacaggguuucagggcuucucuguguaguccucuguauaccaggcuggccuugaacucacagagauuggacucccugguguuggacuaaaggugugccuuaggggcucauuuuguaacccuggcugcuggccuggaacuagguguguaaagcaggcuggcuuugaacuucuuuguggcuaagaauggucucagacuuuugaguacuagaauauagguauauaccacucacuauacccacuuaacaagccuucugagcuccaaggauacucacucacacuucacccauaccuuguuuuguuuauagaauugacuuuucagccagguguggugacuaggauuggaagauugccuggaguuauacaguguguauaaggccuagaauguuuuacauaguaaggcauuaugucagcccaguccuucugccaagaaaauguuucuccucugaggauauauacaaaaucauagaaauuuagaauuuugaauucuugggaaugugguuuuuuauuugaggaagucuuaaauauguuagacuuaaaauucuagagcugucaucuuauuguauuuggguguuuuacuuguucauuuuguuuguuuuugagauaaggucuugcuaugaagaaguucagcuuagccuugagcugugugacccaaacuggccuuaaacuugugauccauuuaucucgagaccucucagguggugagauuuguagccuuaucucacaacagaauauuuuuuaaagcagaauuuguagguuaccaucuuuaagugcuuggguauuaguggcccgugucuucaaucacagcacuggggagguagaggcagguggaucucuguuggaggacacucaaggugacacagagaaacucaaaaagaaagaaacuguugccaggcugugguggcccaugccuuuaaacccaacacuugggaagcagaggcagguagauuucugaguacagccuggucuagggcuacacagagaaacccugucucaaaaaaaaaaaaaaaaaaaagauagaaaaugucacucuaaagauugauuuauaaagaauuaacaucaaaaacuuuacccccauggaaguugggcuucuauuaaaaauaaagacuuucauaaaaugauuuagcauuuaccaaucuuguuauuuguuuuuuuuuuuuuuuuuagauggggucuuuguagcacuccccugguugaauguugggauuauaggugugugucgucauucugaguuugagcugcauuagaguuuuguaaccuggacuuuucuaggcaaaacuugucuucccugggugcuagaauguauagauuauugcuaugccauuuaguauuaaucucuaagaguucccacuuuuuuguuguuaauguuuugagacaggaccaacacacuauuaauccuggcuaaccuggaaccauccauauaugaagaccagguuggucuuagccuaccugccugccugugccucccauuugcuaguauuagaagcauagugggauugguuuuaacuaauauagaaaugaagaauacuuucuaaguuguaguuucuuuuaacacugacaaauaggcaagcaaaauuuaggcuccuuucauucccaaaggcagauauuucauuaugaaaguguuguucaguuagaauuuuugauuugagauauaguuuuucuucugggauuagugguuucuuuccaguucuguugucuuuuucugcaccuuaguguguugucucuuugaagcagucugaauuuuuucagcuguuuuagaacucaauacaucucucuauugccuauuuucucacuuagauuuuucuuuucuuuucuuuuuguuuuauuuuugaggagcgaucuuuuauugggggaggguucaucaauccuccuuggccgccgccuuccucauggcugccagcacgucgcucagcuccuccagcucucucuuggcgcagaugugcgugcccauccucuucuugaugaacuugaguacgcacuuguccuuggacacuuugagcaacuccauggcgcgccacucgcucgaagggugcggagccgcacaccucccggaucauguccacaggaacuuggcgugcuuggugaggcgcccgcgucgccggcugugugucggcuugcugauguuuuuuucucaccuuguggcccuuguugaggcccacggucaugagguagcgcagagccauggcuugcugcucuccgauggggacaggaagaguagauuuuucauuuuuaagauuuuaaugauucuggggcuggaaagguggcucagugguaaggaguacuggcugcucuuugagaggaucuggguucaauucccaacacccacauggcagcucacuacugucuguaacuccacuucaguggaucugacaccaucacauagacacaugcagacaaaacaccauugcacauaaaaauaacuguuuuuaaaaaagauauaguuggccgggcgcggugguggugcacgccuuuaaucccagcacuugggaggcagaggcaggcggauuucugaguucgaggccagccuggucuacagagugaguuccaggacagccaggacuacacagagaaacccugucucaaaaaaacaaaaaacaacaaaaaaauaaguuuaauuuguggaucaguuuuuguacuacauguuauguauuaugcauuguucaauuugacaguggcaagcuguuuuacuagguuguuaucuacucuuauuuaaauaaaagaaagaaagguaccuguguuagaauguuugcacuuuauaugcaggcucuagcuuuagauaaucaagcuucugccaaagaguuuccaggugaaaugacugagauggucuuauuuugaaucuuuuuuuuuuuuuuaaagauuuauuuaucuauuauauguaaguacauuguagcugucuucagacacuccagaagagggauucagaucucguuacggaugguugugagccaccaugugguugcugggauuugaacucuggaccuucggaagagcagucgggugcucuaaccuacugagccaucucaccagcccgagauggucuuauuuuguuaagcauaguacuaacugcuuuucaaaauuaccuuuuugcuuuuugagacaucacuucauguaaacaggacuggccucccaagaggcuguguagccaaggguaaccuucaacuucuaaaccuucuaccucccaagugcuggaauuaucugaugcgugccauugggcuaccuuuauauagauuauugaugaaauuauuagacacccaguuuguauuugagagaauagagguuugggggaguaauuggaacaacaucacagaaggaauaggaaucaaauggagaaacuucaggucuuugugugcguuuguguuuggagucaaggucuuuuuguucagaugagccuggggcuuccaggcucaggcugucuuucugccucguucucguagguagcuaagacuacagauacucuugguucuaacaagaauuguuuaguuacuguaaguuacagccuugguugacuauaggguacugcgccaaacuagaagguacuuacuguugaaagggaucaccuguugauuuuaaguucugguuacuagguagucuacuggaaacucccuaguuuguccagugaccugaguucaguuucuuagcauuaccaaaaaaaagggaaaaaaauguaguuacuaagguuuaccacacuguuacuguacuagaauuugaaacauuaugugucucccugaagugcuguggauugaauuuagcaguuuguuuguuuuuuuuaaauccagaaucugagucuuuuuuuuuuuuuuuaagauuuauuuuuuauuuauuauauacacuauagcugucuucagacacaccagagagggcaucggaucacauuacagaugguugugaguuaccauguaauugcugagaauugaacucagaaccuuucgaaaagcagucagugcucuuaaccccugagccaucucuccagccccagaaucggagucuuuacaugaaauuuagguguuaaguguuugcugcuaaaaaaaaaaaugaaaacuauauggaugaaauaaaacauguuuugacaaacacuuggcuccuccagcccuuguguuaagucuuuaucguccuuaaugauuucucaagaacacgucccugaaguugaugcccuuguuaguuguguugagugccugaguacauuaaacacuguguuagagggaugguaauaguugagauguuuccuuugcguuguuaaagaggaagcuaugaauugugauaacuucacguuuacuauguucucucuagaccuggugaugacuggaaaaagacauuaaaacucccuccaaaggaucuaagaaucaaaacuucgguaaguugggguauagauuucaaauggaagaacugaacaauuaccaguaaagaauugugugaaaugacgcugcaugugucggcuuuuguuuuauuuugagauaauaucuuauauaguccaggguuacuacacacucuagguucuccuuccauagccucauuagugcugggaguauaguuaggugugugcuaucaggcuagcacauagguuuuuauuuuuauuuuuuuauuuuuuuuagaaacauuuucuuuuacagauuuauuuauuuauuacauguaaguacacuguagcugucuucagacacuccagaagagggagucagaucucauuacgggugguugugagccaccaugugguugcugggauuugaacuuuggaccuuuggaaaagcagucaggugcucuuacccacugagccaucucaccagcccagguuuuuauuuuugagcagauaggguuucacuauuuagcugaggcucuguguauugaaauaguugaaacuguauaguuaauagauacuggguugccaaaauuuuacuaacagucuuuggugggauuacauaguagggguaacauauuaaguaaugugugugugugugcaugcauaucuugguuauuuuguuuucuuuuuccagacaggguuuuccuguguagcccugguuguccugaaacuagcucuguagaccaggcugacuuggaacacacagagauccaccugccucucugccucugccuucagccuagcugcauaucauaaccuuauuuucucaauuuuucucagccuuucagggagauauacaggcuagguauuauaacuacuauguaugaguauguaagaacagaaguucuuuuauuucaauauccucaaccaagggugacuuuuuuuuccuuuuuuuuuuggugaccaagggaacauuaaauaauagcuagagauccuuauagaguagccucaaaucagugaucugaccacagaugucaaagcagugugcuugagaaaccugaacgucgcagagauguugguagcugugaguggggagaacuugggcuugauuuuacaucuuguaacuaauugaauguuauuuauguagaaauacucuaacuagacuauggucauaugugguuuugccuaaaguuccauuuuuaaaguaguguuuauuuguugaagguagaguaguuauuccucagggcaguuuaaauagggauuaaagcaguaguaguaaaguguguguuuagacugaaguggggaaagagcucagccugucagggugcuuuuuaagcacgcuaacuguaaaagaaccuugaauguguuuuguuugauuaggaugugaccuccacaaaaggaaaugaguuugaagauuacuguuugaaacgagaguugcuaaugggaauuuuugaaaugggcugggaaaaaccaucuccuauccagguauguucauccuuuuuguuauaugaagguuauguaucaugcauuauacacuucaaacauuuuaaaaaauacagcugggugugguggcauauaccuuuaaucccagaacucagggggugaugccaggcagauuucugugaguucaaggccagccuggucuacagaguaaguuccgggacaguuaggaccacagagauccugucuuagaaaacaaaacuaaauuaauuagguaauaauaaauuucacauguaugggguguuuuaucugcuuauaugucugguaucaagcaagaagaggaccucagagacucuggaacuagaguuaggagccauaguguaacaugguaacguguccuugugugugugugugugagagagagagagagagagagagagagagacagacagacagacagauagacagacagacagacagacagacaggguuugcucuaauccacacuagccuuggauuugaacuguagucgaaaguggucuuugagcucuugccucacccucccaaaccuagaauuauaggcaaacgucaccauuccaccguucuucuugaacuuuuaaaggcuaagucacagaauccaucccuuuacuuaugagucucuugguguuuauuucccaagaauagggguuaugugucuguaggguucuuuauugucauugguugaugguuucaauauuucuuuuuuuauauuuaaaauuuuauuuuuaugugauuguuuugccugcguguauguucauguaccacauguguucggugccugaggaggccaggcaaggauguuggaucccuuggaacuggaaucuuaaguggucuuguacugccaugcggauucugagaaucaaacuugaacucucuggaaaaguagccaguguuuuugacugcugagccaucuguucagcuccuggauuuuauuuuaacauuuuguggaugugcagaggucagacacguacaggagucaguucucuuucuacuguagauucuggggaacagacucaggguguuguacuuuuaucuaccaagccaucuaacuggcccuguuguuuuuugagacagggucucauguuucccagcuggccucaaacucuuuguaucuaaaggugaccuuaaacuuguaacccuuguguagaauugugcugggauuacaggccuguaaagucuugucugguuuauauagugcuggauggagauggaagucaggguuuugugccugccaggagaauacucuaccaauugagcuacgucuccaggcucuuccauuuauuuuuugaaacagacauuucugaugaauccuugugauuuggcuuaagucauguuuucucagcaaaauacugcaaagcagauuucucuagguauugaguuugaagauacauauagccugucuggugacgucauuaauuuggauucucuuguugcaauccaaguuuugucugauguuuuccuccauaauguauggcgucuacuacuuuuugccccucuuaaagcuaaucuuaacauucuagagaagauuuaaaaccaaguaaguagccucugucugucaagcuuuacugguuauuaugauaaucuccuaauuaccaucuuuagucuuccuugauuccauuggucuggguuauagugaguuucagcuuaauugguccuuucauauuugguccuuguaaagaggaaccugcccuuguauguaaaaaaaaguagcaacaaaguagcaacagaaauaauuuuuugauugggagucaccacaacuuuuuuuuucuuuugguuuuucgagacaggguuucucuguguaucccuggcuguccuggaacucacucuguagaccaggcuggccucgaacucagaaaucugccugccucugccucccaagugcugggaccaaaggugugcaccaccaugcccggcggaucaccacaacuuaaggcacuguauuaaagggucauagcauuagaaagguugagagccacuguucuaaggaaauacagcuagugauuccccaaaggugaggaaggaagugaaguguuuuguucuuguuuugacccagucucacuguauauuucugucuguccuggaaaucacucuguaaaccaggcuggcuauagagaaccaacugcuucugccuccccaguacuggaauuaaaacaguagacuaccacaccugccucugugugugugugugugugugugugugugugugugugugugugugugugguguuuuuaaacaaaaggggccuuguuuaccucuggcuggcuuugaguucccuguguagcugagaaugaccuuaaaccucacaccuaauucaugcaguacugagcaucagaccuaugaaaagcauaaaauagugauucuuagaaucacucaagagucuagauccaaaaagagauuuacaauuuaccuggaacaaaaugagccucagcauaggcugcccuccgcucuuauucuucgggcagaauuuugcuauguagcuaagcugacucgcaacucuaaaaaucuucuggccuuaaccuccccaagugcuagaauuguagacaugggccagcaaaccugccuuuuaucuacuuaccuucucuccuuaucccuucucuuuucuuggcuuuucaacacaggguuuccucuauguaacccuggcuauacuagaacuugcuguguaaaccaagcuagcuucaaacucagaucugucugcuuucugcuaggauuaaaaguaugagacacugccuagcuguuuguuacccauuuucuuaaaaaugauccaucaucuuuuucaguauuuaaaacuacaggguuuuuguuuguuauguguuugcccuuauguccacaagugcaccaugugugugccuggugcuggcugaggcaguaagaggccccugcauccccuggaacuggaguuauagacagcuaguuggaaggugccauugggugcugggaauuaagacuagucgcucuagaggagcucuuagccacugagcugucuccagcccugagauuauagcuugaaaggacaugauuuuuuagauuuuuuuuuaauuguguguguuuugccugcaccaugugcaggccuguuccuggaagagaucugaagagaguguccaaucuaggauuagagauauauauaaauucugagaacugaaccuggaucuucugcagguacucuuaacugcuaagcaauuuaauggauauuaagaaaaaaaaauuaaagccuucuugauuagauguuuaagcuguacacauuugaauuguguguguuuuguuuuucaguguugcugguuuuuuacuauuguuguuucauguguguuuguguuugcagauagggccuuauuuuguagcucaugcuagccuggaacucacucuauagcccagguuguccuugaaguugcagcaauccuccuggcucagcuucccaaguacuggguuacagguaugaguuuucaguucucagcugaacuuugagugguguguguauguauauggcaggucagaggaugaccucaggugguguuaucagucaccagucacuacagagccuagacugaaucucaggggucuguuugucuuuguuucccaaagguugggauuucacaccccugcugucaugacuggcuuuuuuuuaaccucagugcugggaaucaaauuuaaguuguggugcuauugaagcaagaacagugccaaaugagcuauuucucucgcccugagcaacuucugagaggugauauuuaguugugauuugguuguuagcuuauuggaaaaugaggcauaugaaauugcuuucucaaaagagguuuuacagcgacaacuuggaacuagacacaaccaauugugccuguacgucucuccagauguagccaucuguauuggguacucagugagagugacuucauucuaaagguagcguguagcauguacuccuugggagggggggagggcgggccugggaaucuucuuuucucuaguaaccauuguacuaacuuuggauucuguuugugagguggcagcucuauuuuuuuuuuuucagauuuauuuauuuauuuuguguauaugaguauacuguagcugucuucagacacaccagaagagggcaucagaucccauuacagaugguugugagccaccaugugguugcugggaauugaauuuuuaagaccucugcuugcuccgguuagcccugcuuacuuuggucaacuccgcuugcucugccccaaagauuuauuuauuauuauacauaaguacacuguagcugucuucauacacaucaaaagagggcaucagaucccauuacacaugguugugagccaccauaugguugcugggaauugaaccuggguccuuuggaagacagacagugcucuuaaccgcugagccaucucuccagccccuggagugacaacucuuucauguugaguuaugugaggaucagaggacaguuuugggugucaguccuugccuuuugcuuugaggcaggggaucucucuccuguggcuuucccaaucucuaauugcugugugugcuaggcuagcuggaucuugaggacucugucuccacccccaucucaccauugaguucugagauuacagauacagacucugaugccuggcuuagcuucugugggucuggggauucagacucagguccuccugcuugcucacauuagguggcuauauguacuguuacuaaccaaccacacucccucccugaacccacagugaaaucaccacaggaaaaauaagguaguuuuauucuuuuaauuuugacguccaggaugaccccaaacucaagaugaucuuuguacuucagacuuccaagugccgaaauuaaagagugccacuaacccagggucucaccaucucacagagaucuuaaagauaauguaucaccaugcuguucccccaccccacccccaccgcccccuugagagugaauuguuucuuagccuuuaucaacaaguaugaggaguccugccuuuuacaguauauuaugcuaaaugauagcuaacauauuuuuaaaauuucauuuguuacucugugagcguguggcuaccaugacacacacauggaggucgaaggacagguuuuaggaauuucaugugguuaagccaauaggcaagcacuuuuacguacgcuaggcuaugcuugucuuacuggucauuguguuucuuuuuaaucuuucugguuuugacuucuaaaguuuugugugugugugaguggguaugugugagagggggagggagagaaguggggggaagacacagguugcaugcucuccaagguacacauggagaugaaagcacguuuuagauaugggacuaaauucaacaggguugcacuugcaaaacauaaaaaucuguugagucauuuuaccagccuccagugauauuuuuaaccaacaaacaauuguguuuucagaaauacaccagugaucaacuauaacuuaagauauuuuuuacuuuaguaauaauaaaaacuuucuguguuucagaaggaagagggggcucuucauuuuuauuuugugaagauuuugaagaaaaacuuaacauuuaagaacuauuucucacuuuucugaauuacucagaagagagcaucuuuuuccauuugguuuuuuucuauaucuuucccauacaugcuuuccuuaaaauuuugggcuuccccaacauucuaggcuugcuuaugcuuucugagaagccucccuauucaucauguggcugccuagccucuguguaccuaccugccuuacaaauuccaaggccuuuucucuucuccucccagcaguuacggaaguucacaaaccuaacaaaauugucguugagcuaaaaaaaaaaaaaaguguguguguguguguguguguguguuaguuaaaggaaggggcuggaguguggcucaguaggauggaugccugcuuagcauccuugaagcccuggguuugauaucugucuagcacaagauaaacugagcaaucacagcacuugggaaauggagacaaggaggaugagaauuucagggucaucugugugaguuaggaggccaacuuuggauacaagcaauccuuggcucuuuccuuccuuccuaccaaaagucaaauacagauuauuauucucaauagagauaaauaaaauguauuugguauaauuagcaaauuguuacaguugaccuuuuauucaaagaugauauguugaauuuggaacucuaggaacagugagccggcucaaaauucuuugacuugccugagcuuuuuuaaauaugggggcagaagguaugggugguuguguacucaccugccugcccguguguagauccacagcuuccuccuuuuucauggcaugcagggaugaggucagcaggcuaugcaugcaguaagugcucuuagccauuuuaccugccaguuuucugagacuuuucaguuuaaaauaaguucuuuauauacuauauacuuacucuaggaauugguuaggggucaggggauugagaaggcuaaaggcucugaaacaauauacaguuuucuaaaacauugucuuugaggagcuggagagauggcucagcgaggaagagcaaugacuacucuuccagaggugcugaguucaauucccagcaaccacauggagauucauagccaucuguaaugggaucuuaugcccucuucuggugugucucaagacagugacaguguacucacauaaaaugaauaauuaaauuuuuaaauuaaaaccccaaaaacauugucuuugaaauauuucacugagcuugucagcucaugaugggaaagguagugcugggugggggggggggggcaaaucaagaggguuccuaagaguccuggggggggggggggagcaaaucaagaggguuccuaagagucuucgaccagccugggcucaaacugacagagccaugacaaaacaaaccagaaagcacugagugcuucucaugcuuuuagguuuugagaugaauaagggagaaagaagcuuguguguguguugggggcaggaggggugaguuucuccucaacuugaaggguuggcucugugccugaauguuuagugauggugacagcuagcagcagcugcuccuccacuacuguuaaguugucgcuccuggaguuucauggccaaagcuguuugucucugaagcacauugacguggagccauuauaugaaguuuuaggauaaggaagugguuugcauaguuagcuggacuguaaugucaaauuugagaguggcagaacauugauuuuaguacuugauguuugcuuuaaaguauaaaauuauaaagguuuaauuucuuuucagaauucuaaaaccuugauuuuuauggggcugaagagagguggcuuaugauuaacagcucaucugcuugccgagggccuggguuggguucccagcacccacaucucaguggcaccuaacucacuuccagggauucuugacacucucuuuuggcuccuccuguacugagagagcaagagagaaacugagacagagacagcgagcaagacagagacagacagacagacacacaaauauacauacacauaaguaucuuuuuuuuuuuaauuucuuuauuuuacauacaccaugagcacacuguagcugucuucagacacaccagaagagggcaucagaucccauuacagaugguugugagccaccaugugguugcugggaauugaacucaggaccucuggaagugacuggaaaugacuacucuuaacucugcugagcaucucuccagccccguaaauaucuuuuuuuaaaaaagcuuauuuuuacacgcacucuuuccaaacccuguuuauaaaagcuaagaggucauuauugacagguuugugaacagguuuauuuguaggauuuuguagcugaacaauguacauucugucuuacuuugccuauuucccuuuuuaauuucuauauguguacuuauuuccaguaacuugguaguuauugugucccagauaauaaguauuauuuuuguugugguuauugaaaacacacaugauaaaguaaacuuaaaaaugaaaaugaaaugucacuuucagugaugugacagguccugucuucagugaaacaugauucaggacagagaaguuguguguugauaaauacucuggaaguugauguaauaaaaaauaaguaucaacuaggccccagagauaagugauuucagcuuaguucuauguuucuauuuuguguaagagaaagcucaucuuuuuuucucccccucugggauuuuaggguuuuguuuuguuucuguauugggcauugaaccaaaggccuuacagaugucucagcauacacucaagucagugacuuacacuuccaaccccgugugcacauuuuucauauggcaugauugacuuugccagucugaaaacagcgugugcugucaacugaccuggacucuuggggcucucagaguccgaaccaccaaccaaagagcgugcacaguuggacuuaggccuccccgaacauagguagcagaugugcagcucagucuucaugugaguucugaaccacgggcuggggucaccccaaaagcuguggccugucugugggcuguguucuuguagcugugcugccuugucuggccucagugggugaggaugcaccuagccucacaaagauuugaugugccagggugggggaguacccaaggggacuccccacucagaagaagggggagggccaguaagugggauguaaauugaauaauaauaauaauaaauuuaagaaagaaaauagcaugugcuaucuaaacuuuccuuggaguuagugccccuuuuuucccuguuuucagacaggcucuuacauuugucaagcuggugucgaacugcucaugccuacuaggauugcaggaaggagcuacuauguggcuauuuuuauuucuaacaaaaaugucuuguuugaggacuauuuacaacccuuugagauuuuuuuccccucacauacgcacacuuuuguuuauuugagacggggguuuuuaguuuagcccuggcugccaagaccagacuggccuugauucacacuaaucuaccugauuaaagguuugcaucaccacgccacacccgucucacuacccuuucuguugugcugggaugagccuacuauuuuuuuucuguuaacaguuuuagcaaacuuuugguucaaagugguguuaauacucacugguccuguuaacccaccugggucuuugccauucaugcagcguacauagugcacuucaaagcaguaccaaaaggcuauucuaaggugugacacagagaagaaucugguaauuuuuuuauucacaaguaauuuuugcauccuugucuuuuaggaggagagcauucccauugcuuuaucugguagggauaucuuagcuagagcaaaaaauggaacaggcaaaagcggugccuaccucauccccuuacuugaaaggcuggaccugaagaaggacaauauucaagguuaguggaauaaagagggaggggugggggcaggacugucuguacuuggagcuuuguagcuuuuagucuuggucagaauucauauaaucuacucucuuaguauauuugccuuaagugucuaaaaauuauuuucaacuuuuaaagggaauuucccaucuucagaguacuuuuuuuaugauugauaaacaguuuuuaaaaugcucaugugugauaagcaacguaaguaaaagcaaacuggugagaggcugagccagccauugcucacagcugugcagccaaacuccccgugggagccauguaagcagagcccguguagaaacaguaaaugcuucugguuguagaggcuugaguuuaucacauuguaagagcuuagacaguagaaaagaaguaaauuucuauaguuguaucuggagucaauucauauaauuaagauuucaccucuaaagcauuccuuaaauugcccaaguuucaauuuauaguucucucuccugucguugaugcaacuagaaccugaauaggaugcauuugcuacuuaaguauuuagauuagugacucuuaugucaagcaaauguaguuuuuaagacuguuauauuaauguuuauguuaugccuguguguuuagacauacugccucagugaaacuauuuuuauagcuucuuaaauuucuaaaagaugguguguucuuauucucucuucucccgcuccuuuguucuuugcuauuuucuagcaauggugauuguucccacuagagaacuugcucuacaggucagucagauuugcauccaggucagcaaacacaugggaggggccaaagugauggcaaccaccggaggaaccaauuuacgagaugacauaaugaggcuugaugauacagguaggaaaugaggcaggcagcagggcugucugauuauagcuacaaaugucucguuuauuuuucagacuuauucgugauuauguggaggugggguguggcuaugcacaugugugugcaggaggugccuauguuuguguaugggggggggcaguggauccccugguucuagaauuaguagcuacugccaauugaacuugaauucuuuacaggagcaauaugagcucuuaaccacuaagccaccucuccagucucuaaggguuuccuuuuaggaaauaacuaaaacuuuguugguuguuuuguuuuguugagacaggguuucucuguguagcccuggcuguccucaaacuuaauuugugaacuaggcaggcuucaaauucagagauuuaccggccucugccucccaguuacuuuuauaaaaagcauaugcuaccacugucuggcccuaaaauacgucuuuaauuaacuaagggacugaggguggauuaguagguaaauugcuugcauagcacauacaaagccuugauuauuuccccaccaaacaaauuggaguuagugacacacaccuauaauuccagcacuggggaagugaaaguuagaggaucaaaagucaagguuauccucgccuacauaaugaguucaaggccagccuguggcacaugauaacccuguuuuaacaaaauaaggaaucaaaagaacagaaacacugugguagaaaaugaagaguaaaaucaaccauuucuuucuuuuaagaggaaaaaaagauaacuaaaagguuauucagccuuauuaguaguuuugguuuuuguuuuccuugacaaggucucucuauguagaccaggcuguccucaaaccuccaacucacagagaccucucugccucugccucuggaauucugggauuauuuuuuaguauuguuuaauguaguucagaguaccauauuuauauuaacuguucuaaauuucaaggcaaaaaaguauuaguuaugagugauggauauuuguggaaaguaggcuguuuuauaacauaaguguacaauauauaugacaguauauuucagguuauaaacuuagauuuucaaguacuuugauaaauauaaaauuguauauaugcaaaguuguuuacucugaaaaagaaggcaaauuuaaauauuucaggagauugguuagauucagugagccugaauggaguuucacagucaguaaagauuuacguauugaguuuuuaugaagggcuguucacuguauaaugcugggugaagaacaguaacaaaauagcaagagucagguuuuacucagaauguuaauauauauuaguauuugguuauuuagcuauauuuuuuaacuugcacaauuuuugguuuagugaucagucuuuuuuuccccuuaaaacagucugagcagcauugcccagauugaagacaugucuuuuguaugcgaaacccuguauucuggcuguuauuucuugcagauugucauaagauaaaaguuguaugccuuuaguuggaauuaguaauuugggaaauuagcccauuuauugaagaguugaaacaaguauugucuaccugcuguaagaagagaugaaaauauacagcccaaaauacaucuuuguaccuuuugguauuaauuuguaccucuauaaauauuaucuaugaugcuaaauauauacuauaaaguuacaaguuuuuuuuuuuuuccguccuagguaaaauuaacaagagaguauauauuuucugaaucuuuuuuauuuuucccuguaaaucuuuguagugcauguggugaucgcuaccccuggcaggauccuggaucucaucaagaaaggcguggcaaagguugaccauguccagaugauagugcuagaugagguaauguuccugacuguccuccucugagcucagcucacacccuguccuggauacgugugauuagaaauaaccaagccaaguucguuuuaugucuuucuauucaguguuaacauuuuaaaagcauguaagcuaagcuaagauaguucuuaacccuacccuuuguuuuacaucugcuucuuuauauuguuugguucaugugugucugaaauuuguuacuuccuuagguuauaaccuaauaugaauuccuuuuaagaaauuacucgacugaagccaaauguuuuaccugggagguagagucagaugucugucuugaauuugaggacugcauaguaaguuucaggccagucaggacuacaaagugagacucugucuuaaaaauaaaaaacuacuccucugugucucucggguguagcagugcuauaugcauuuagugugucacuauuaguguuuugguauacagcuauuuuccuuuucuguuuuguuuuagauuacuaguuucuggcuuuucacuaaugaggaauaacacugacuauuauauauugaguacauaaugugauauuuagucugauaagauauagguuguuaugggaguguggauaaccuguguccauaguugaggacauugaaacauggcuaagugguacccaguacagcuaacgaguaaaacauuucagcccaaauggccuuggauuuaucguccuguuucuucuaccuucugagaguaagguuuaugccaaccacaucuagcucaaaacacauuuuugaccaauauacucuauuaucucuuuaauggggaucacauuuaaauucugucaaagaaaaggauuuugacagucuacauauuuuuuuccuuagggauuauagccucugcuuuaagacagauucauaauguagcccaggcugaccucagcuucucacuucucucccaggucagccacucaggugcugagcuuacaggcauaugcuaccacgcuaggcuccucccccuuaugcacugcuagggguuguccugguaacauugucuacauuagagucuuaggguuauagccaggagaagccuguguguagguugugcauugcccuuugcuuauauugcucuccaaaacuuuuaaugccuuauucuuuuuuaaaaguaacuuuuuuuuuguauuacaggcagauaaauuguugucacaggauuuugugcagauaauggaggauauuauucucacacuaccuaaaaauaggcagauuuuacuauacuccgcuacuuucccucuuaguguacaaaaguuuauggugaguauuagcucuguaccuggcaucagugcugucaugguacugagugugcuuuuaccuguaauuacauuguauuaucagaauauauguuauugcaagguuucggauuuguuuuuuuuaauauggucaauaagauuugggcauggauuuaguuuuuugagacagggucucacuguguagcccuggccaguaugcuagcuucaaauucacagaggucucugucucccaaguacugggauuaaaaauauguaugugcacuuuuuuuuuuuuuaacuuaaaugaccucuacuuguucugaggcuagccugguuuacaugaguuccaugccaucuguccauccgucugucaguuggucuguuuuucucuuuuuuuucuugguuuugauuuuuggagacaguuuuggggguuuuuuuguuuguuuguuuuuguuuuuguuuuuuuuccgagacagggauucucucuauagcuuuggcuguccugaaacucacucuguagaccagacuggccuggaacucagaaaucugccugcuucugccucccuuggagacaguuucuauguguagugcuggcuggccaugagacccugcuucaaaaugagaggaguugugauuuuuuuuuuuuaacucugugccaaggugacauaucccaucguaaguugguuauagcucaucucugugaggugcauuugaaucugaggucuaccauuuuaguauaacuuauuuuaugaauacuugguuuugaaaagagauucauccuuuagagcaagagacaaaauaaaaaaccaaaaaaaaaagguauaaacuuggggcaagaaaugggagcucuugccuuagcaugccugaaagucuuuacuuaaugacuguguucccucccacuccagaauucccaucugcaaaaacccuacgagauaaaccugauggaggaacuaacucugaaaggaguaacucaguacuacgcauauguaacggagcgccaaaaagugcacugccucaauacacuuuucuccaggguaaguagugggcuuuugugcugaguccuguccuucacuaauuccuagcaaguuggacaauuagaucauuuucccuuuccuuuccuuuccuuuccuuuccuuuccuuuccuuuccuuuccuuuccuuuccuuuccuuuccuuuccuuuccauuccucuucucuuuuuuucuuucuuucuuucucuuucuuucuuucuuucuuucuuucucuuucucucucucucucucuuucucucuuuuuaauuuuauuuuugacuuuauuuucacuguaaaaaaucuuacuguuuuguaaaaaguagcuuuaauuggcuuacaguugaaacugauugacacaggugcuuuauauuguuaaauaauuuacuguaauuacaguucauccuuugugaauacuaauugcuaaaauuuauuugugacccccaaauuaguacugaagguuuugguuauucuuagacauauacauuguggacuuaaaaaaaaaaaugaucccagcuaagguccaagaagaggacagacauucugucuucuuguuuuacuuauaaaugcuacaauuguuuuucaaauuuuggugcuguucaucauucauuccaaaaugacggccucgcugcugccgacgugcuuaccuguguucugaagcacagggggacugauguguacuacacagggaaaacauguacuggguaaaccuccugcaggcacggguuauauugguuaggacuauagacauacuaaauaagacaugcucaaagaaaacacauaaauuggcauguuuaccaauuuauaaaaugucaccagaggcucacaaguacuugucauuuucucuagaaacaguguuguuuuaacuuguuuguuuucuuuauuuuaaugagucugugucugugugggguuguacgcauaugagugcaguuucuggaagcauccagaaaaggguguuagagcgcccgaaggagaguuacagguaguuggggcccacacugugugaacugaacugaacuugggucuuguugaauaacagugugugcuauucacugcagagccaucucuguagccucaaagcagugguucuuauuugcugagucaguguuagcagcgguguauuguaggacauuacuguguugucucugcaaguuagguggcccuuaugagauaaucuucucuaggucgacaaauuuucaucugaaagcuuggcuagauauuuucaugauuggauaaacagaugcuucugucuuucucaucuuucucaucuucugugcuuagcuucagauaaaccaguccaucauuuucugcaacuccucccagagagucgagcuacucgccaagaagauuucucagcugggcuacucuugcuuuuauauccaugcuaaaaugaggcagguaaggauaauuucgagaacuugcauagauuuaauaaagaaauauuuuccuaaguauuucuuauauuuucuuuuguuauaauguuguauaaaugccuugugugugagaguaaacuguugucuuaagguagguacugcuguauuagugguagagcaguguuccagaaaaagaacaaaugaacggacuauuuaguagacaaagagaccuucacuuaaaccaauagguuuaaaaagcaguccagaaaugucagaucuuggggcuggagagauggcucagugguuaagagcacugacuguucuucagaagguccugaguucaaaucccagcaaccacaugguggcucacaaccaucuguagugagaucugacgcccucuucuggugugucuaaagacagcuacgguguacuuagacauuauuauuaauaauaauaguaauaauaauaauaaaucuuuaaaaaaaagaaaugucagauuguccaugaaguccuagcauuuaaaguaagugaaaagcucagagucauuaucuguuccauacuaaguuugaaaucagccugagugacaugaaauccuguggggagggaagggcacaggagacauucuuuuggggggaauuucuaaauuuguucuguuuagugcaauaacuuuauuacauagcuccauguacccauuagacuagguaaaagcaaauacaauugaaagguuuguuacuuagucaaaucccugaggcuggugacuccauuauuggagaauaccagugcaauuuuuuuuuuuuuuuuuuuuuuuuuuuuuuuuuacagaaugcacugcucuagauuuuaauauacaguaacuccuccuuacaaaggagaguucugagaucccauaucggauaccuaaaaucauagacaguaccagauuguaugugcaugcuugcuaugaugcaguuuauacauuggauaugguaaaacguucacuaggauaauaaaauagaauaaauaugacacuauauuugucauaaauguuacgugacuaugaucgcagcauggcuuauuaugccuguccuuuuugauagaaugcuuguaugauggaaugaaguguaucauacagacauugagugauacagcucuagacugcuacagaagcauagguaguuguguaaacaaauuugggguugaagaacugauuggguaagagaaaccaugaugaaaauuuugaguugucuauaaauuuuacucaguuuuuauauaucccccuacccuccaggaacaucgaaaucgugucuuucaugauuuccgaaauggcuuaugccgcaaucuuguuugcacugguaaguguuuuuguauuucuuggaccuacuguuuucuuaauuggcugguugguuuuuuuguuguuguuguuguugguuuuuuugucacauagugaaaccuaugugacagcuccuuacacccugcugccacuuugacagcuucugaagacaggggugccugcuguuuaguuccuagguugagagcaggugcuauucagugccugaccuuggguuccuccuagugcucaugcugcacacguggcucuaaauuagguuuugcauuuaugugcuuucugaacaguucuaacauacaaggugagcaaacacaaaauaaacuuuacucgaaauuacauuuuagaaguugugucuauuugauuuuuuuuuuucccagaaucacauuauucuauaccguaagccaagauuuucuaauuuuugguuguucuauuacuacagaaaaauaagccuggguagggagggggagacacaaauuuagcucagaaacuaauagaauggugccuucgcaccuauguacuuagaauuuaaucuuacuauuagugugagaagaagaaucauuugaggaaguagaaggacuuggaguuugaacuauaauguauauauugguaaauugcucaucuuuauuuuucaugugaauuuucacauacgcauguaccuauacauucagauaaaauuguauuuaagaaguuuugguuggcugguugguuuuguuuguuuuugagacaggauacuacuauauagcucuuacuggccuggaaauuggauauguagagcagacuggucuuaagcucacuucuuuuguuagcuggccuuggccgcuuaagugcugagauuagaggugugcagcaccacaccugacacaauuauauacauaauauauauauacauuaaaagauuuauuuuaauuugugucugugucuauucugugucuaccacgcuugcacaacaggugccugcggaggccagaagagggcauuguauccccuggaacuggaguucucaggcaguugugagccuguugauaugggugcuggagaugaacgcacaucuucuggaaagagcagcaagugcucauguccaaggagccaucucuuuagccaccuauuuuaaaauauagucaggauuuuugggaaaaugcacauaaacaaaacacuuguuacugcuaccagauauuaaauuugguuauuccuaguaaucaggaaguaacuguaaaaauaacuuuauggaggcagucauauuauugagugguuagcuuuuuaaaguuguguuuaaauauuuagcuguguauagauauuuuuuuuuuggacauuugggaaaccuauaaaauagcuuacuagugaaaguaaaguuguuagucaaauugaauauucauaagaaaauugagacucuugcuaucaggcaccugccuccaacuccauuuuucaacuuuaaauaaaaaguuggcuuaagagcuguaaauucaaucccaacauuaaaagaagacagacauugauaguauuacuacacugguuaauugguuuauuuguuuguugagucagggucucauguaagccaggagagccuaaaguucagcuugggauggccugcuuccucuucugagacaaaggauuguggguacugauaugccaagcuuuaccugaucuuggaauccuaggauugccuaggguuaggguuuuaugcacugcacucauucaagauucuuaauguauauguggaaugcuuugguauauaaaauccuacuuguuaggguggcugacacaguuugaggcuagccugugcuacagauugaguccuugucucaaaaaagcaaaguaaugagaaaaugccacuucuccuucaaggaauguuaaauuaauuagaaaguugguauuaaaacuugcguaccauguaaucuucauuaaaaguacuugauuuugccaucucagaaucagccuuaagauggaguacaaaugaaugagcauuaaaaauaaaauuguaaaaaacaaaaaacaauaacaaaacuaguuggugccagguguugugcaaucagcaagcacuugggguaggggcaagaaggucacuucagguucaagaccuuccugcucucugcuagccagaggccagcuagaacuacagugaccuguagugaagauaguugagcuugguugacaagggaguaauguaauuauuauccuagugguuauuggaauacacaagaaauagcugucaagucguuucagaagggacgggguuuuaauuggcuuuauggacuggguaaauuugauguggagaaaaaaagauuucaaguuugaagacuuggguuaagaauagugcauaaaggucuacacagaacggcagugugugcuccuaauccugacguuuggggguuugacagaggaacacgaguucaagacuagcuugggccaccagugauccccaccucaaaaagaauucagugucgugagugguuuuggaagguuguugugagaaaggaaggaacccugauuaugacccuguugugagcgugagggacuuugccuauuaguuuacuuagaugaguuguaaauuguuuaccauaaguggauggaggacuucuaaaagcauaauuagugaauuaccuuucaauaaugaaaaucauuacuuguuuguuuguuuguuuguuuguuuuuucagaucuguuuacccgagguauugauauacaagcugugaaugugguaauaaacuuugacuucccaaagcuggcagagaccuaucuucaucguauuggaagaucagguaaguaagaauggggguagccucgcagacauugcuugaugagaaauacaaucuuucauuuuuccuuugugaaguaaaguauaauagcugugagagcagugaaaucacaucaauugacuuguuugauauuuaaaacuaaguaauuuuuuuauuaaucauuuauauuuggagacggggucuggcuacauacauagaaagcccagguuauacuggaacuuaaaauguaccugccucagucucccaagaccuugugucauuuauuagaguuaagccugauagagcaccugaauccaauccugauacuuacguaacaagagagaaacagcugucaacacacacacacuuuuuuuuuuuuuuuuuuggagacaggguuucuuugugcucuggcuguccuagaacucacuuuguagaccaggcuggccucaaacucagaaauccgccugccucugccucccaagugcugggauuaaaggcgugccccaucaucgcccggcuaaauuauaaaacuuuuuaaagaauguucuuuaaagguaagcugacuguaugugguguacacuugggaagaggaggcaggugacaucugaacaccuguguguuagaggccagcugggguuacaaacugauuuugaggccagccucaaacaacaugauugagacccaauuucggggguugggggaguuaaaguaagcuggaaaugguggcacauacccuguaauccuuguguuugagagauugaggcaggaggaucaugauuauaguugguagggggguugggagaaauggguuugcucucaaagagccuguaaagcccucuguuugauuuccaguacccacaucagguaacauaaaagcacuuguaacugcaccuuguuaauaacaaaaaguuaagucacauaguaucucacaagaagaaagaaggaaagaaagagguuaaaguaauuacuauauacuuaaagugaaacacaagaaaacuggauugauugaaugguguaguguacaaguguauuguucaguguguguauuuugacagucguacaaacgaguauccaguuugucauuucaaaaccagaaaauuagguauagcugucccucgggguucaugagcaauggguuccaggacccuugccaacaucaaagucuggguagucucuuaaaagcaugugguauuagcauauaacuggugucuauguuacacuguauuguuuagggaguaguuguccagaagucugcugccuguucaguacaguugaugugccaagagaaagaccuaaguuguuuuguuuuuuauuuguucaaucuuguuugugccauucagaaugccaccaaaugaauauauugcugcucuguguuuuggcauauuacagacuuguuaauacauguugcucucaaaacauguuagauagauacauacuuuuauauuugaaucacuuuauuuaccacuuaaacuuuuugccaauuuuaaacucauuaagcacauuuuucuuuaggucgcuuuggucaucuuggcuuagccaucaacuugaucacuuaugaugaucgcuucaaccugaagaguauugaggagcagcuggggacagagaucaaacccaucccaagcaacaucgacaagagccuguauguggcagaauaccacagugagccugcagaagacgagaaaccguaacaagcacguauguaccuaguaaccugacagaaccuucaaggauuuccaaacccugcccagugugagcgagcgccugcagucgcagcacucuggagacuuugaauuggggaaauaacgucaguagggccgcauagcccuacuauucagaacacaaaaggcuuuucugugaugcuucucuuucacuuaauuuuuauguauuuguuuuugagagcggcucaggcagccagagaugccuucaaacucuucaucuacuguaggauagucuugaaaacccaauguccaugcuuccacuuucccagugcuggcauuagagaugaaggccacacccauggccucuuaguugugaaugaaggcugccugcagucagaacuuggaacgucucauucuguccuuggguaugugggaaacuuguaguuuaguugauuuuucucagccagccuuuagcccuagcucaacugaaacagacuggacuugccugcacgagcugcaacagccaagugaaaucuuccauguaacuaguagaucaccuuaggagaagagagaguuuacuguaaggcuugugaaaacaugucuccuuuuuuauauugcuuucauggauacuaauuuuaaauuucuaaacuuuucccauaggcuuugacaaacuacagaaggcucuuuggaucugugacacaucauuuugggggggugcucuucucuuuguggguuuuuucaucuuuauuuuggaacuaugaagaguuauauaagagcucagacauuuuucuuuuuuuuaaacuggugaagaaaaacugaaaagaagacauagaccuuuuuuguuccacuuguuugcacugugugcugacugaacauucguugcacuaacugcuggucuuuaaagauguuuucuggggaaaggggacaaggaaggaggaaaagaaaagaaggggagaaacccuaaaaaagagaagaauuugggugaacacaugcaccugucuaaaguucuccacuagcugacucuacugcauuucaacuucucccugauuauucauccguuuuuaagccugaagagcuuauuacuuauuugugcgaagugccuuaugcuacaagaccauuaagaauaucaucuuuacacacagcccaaggaaucaacagagucauguucuauuuucuuuuuuauuucuuugccucuucauuuugguuucacguugaagucucaccuccuguucuaccaguacucagcccagggccggaagguggacuagugauggcagcgccauuuuccuuuucuuuauauggaggaguugauucacaacugcaguccauccacacuguacauacauguauuuaaaaaaaaaaacaauaccaaguaaaauuuucuuccgggcugaguagacguaccaucgucgcucccaaaggaaagagcagccucucacugcaggagccagaugacaagccucugugcucuacagcagaacacuacgcuggcucacacgcguccaugagcaggaaggcacucgcuguaaagacuugucggagggagccuugaccuucuuuccucuguggcaaagcgugacccguagaaaauuggauguguauacuuguauaaacuuuguaaauaaguuuuuuuucuggguucauauauauauauauauauauaaauauauauauauacauacauauauauauauuauuuuuuuuggaugaagguugcugggauuaagggauuagagugauuaugggagcagcuaaagaugagaggggcucaguuuucugcaacacuaaauucuaaaaagugcuuuggccucuaacuguaggaagcagaccucugcaggcucuguguuggaaaggggccagaagcccggccacacugcucuuguaaugaaugcacaggcagcggucuuagcagacagcaaaggagcuuugcaaggcuguggucccugggggcuuugagaagcucugugguuuggcucuccuguccuaaacguuugaggaacuucccaaguucugcaaaggggaacaaagauaaaucuuccuuggagugugagaaguguacagagugcagucuuagaggagaguguguggagcauggauuuuuaugucaccggaccagccagugcagccucggcgggcuuggcaguuguggagccuaguuauccgcggccccuccuguugugugugagcagcgcccucugccuaucuugauaaauacauuuuugcaggaaggggcagcccguuagagcuguuaacguccauguccaugcugcagaaagcugcuugcugcccguucucugugccgcacuaagaguugcugucugucguuuugcauuguaaaucgcuggcagaugccuuaggugguaguguugcuuuaaacugugccccucccaacacgcuugauguuuggccugaucuccaggcaaaaggagggagaugaaucaaccagugaacuuuuuuuuuaaaaauguuuuuaauucccuuuuaacccaguauacuaggucaggaggcaucuagggaacaaaaaaagcaaaaaacaaaauuuaaaaaaaaauugauuuucauauuccaucacuuugaagaccuuaaaacuaugacaagguauguugagucugcuuccaugcuuaacucgucugaagagaggagucaguuauucaaaguugcuuugacuuugccuaguucuaaagcaaaacuauuugugacuuaucccaaauucuuuggggaucaaaauccuacagaugccuccuuaucagagauaacccugacucuguaacaacuguagcaggagcugcacgguacaaauccccaaaggcaaguccagucaaguguuggcuacaaaacaaaccaaauuaauaaggaagucacuuuuuuagggagggugggaguggggucuuaaaaacucguuauuuugaccaacagaucuugcccuuguaccgaugcagcucuccuccuuccugccuuuggcgagaugagggaucgcuccguagagcaacaugagcaggaaaggaguacaaaugcaaucugcugucucgccagagggcaagugggugaucaacaaagugcagucucuugccaaccuuggacugcucugccaggugccacaugccucugagucccucuuaaagcacagacuccaugggggaguguucugaaguacagccucugcugaggguggcacuuggacagcugggcacccaccccggagaucgcugucugaagaggcggugcugggguggugcuuagcucacuugagcuguuguuaaugggaagaugcccuacugaccaggucaaacccugguuggguuuuuuuguuguuuuuuuuuuuuuuuauccuuuuugaucccucuuaauaaggaauauugcuacuauuggaaauugucuuucagguucuuuccaguaauuuuuaaaguaaugguuauguuuugguuuucgccaguaguucauuucgauaaaaacuauguccuauuuuuaauauccaccucaaugcuuuuagccucuggucauguaguugugugauaaguaacagacuguuacacacuugcugcucagggccuguuuuuuucucucccuuaguguucugaacaugaaagaaacuuucuuaggaauggaauacauuuaccauaaaauguuuuuccuggaaaggaaaaccuaaguagcucuaaauuauuuccaggugggcaccagcaucauaacaauugguuggcccgguggggugggguggggugggcugggugggugguugucauacucguuuucagaaugagaugagggcaucuuuccuuggccaccugcuuugugcuggacaccaucgugcucggugagaacagagcacagcacagaguuuggagugacauguuggaaacaaaacaucucauucugaucauuugguuuauuuuuuuuuaauaggggugggaggggaggguacugugucccaaaagggagggugucugcacuaaggauuuagaaacacuuuggaagcucauaaccucaugggaaacugccuuuagccacacacacuccugaccuuuagaugaguaacaaaaagaugaaauaaguuugugggaauuaagccauguuauuuuaauuggauacuuuuuuuuuucaacucucuguguaucuuuaaaauuguuacuguggaaugauuuucuugccaaauaacuuugucaggcaaaauuauuggccucaugggaggugaaguaagccagauuuuggguaaauuuauguggacuuuggugaguuuguaauucuacuuuauauucauaaagauaguuuuuuaaaacucccaaagcaaaucuauuuucuucucuaauguaaaaacucaucuuuggaauaaagaguuaaguguccgaggguuguaacagauaugaggucagagggagcuagccuggccuggacucugccccuccacagcugacagacuccaacagaaguguauuuaaaucuccaguagacagagcugggcagggcaagggaggggugggccuggguuaguaagcugcaggcugcuguauuuuaaccagugguucuuggggaggggugcuggagaauacaaagucacuucccuuuuuugaaacaaaacaaauuagaaaaaaaccaauuuuuuuguuuaguaaaaauaagaaaauucuaaugucccuagucacaagggaccaguuccacuuugagcaguaggaacuuaaaaauuugaaaacauuuggggaaagggaaaauuggcuuucuguuuaauuggcaaauguuccaguggggagggucuguuuuuguugggauguguuacaguguauguacaugucuauggaccugagucuuuaaggaguuauauacaugguucauucagaaaagaugguugguaaaaucuugauuguuucuuuuuguuaauuuaucucaauaaaagcccacuggaacuuca

SEQ ID NO: 12160 - RNA, 38104 nt, Mus musculus
agcccagccgggcugcuccgcuucaagggaggcucucagcgauacgugcccggcccagguaaguggggcgcggcccggucgcccgcuauggccucgggguugcggugcugaacggggagcgggcaggcuccggcgauggggaccccgggaggcacggagagggacccacuccacccggugaucugcgaggcccugcaacagaguugcaaagugucccgcaagugaccgugcucuuugcaugccacucuccugaggggucggggcgcaggggucggggcgugcuuccccuugagguuuccucggaacggggagacccuuuguggggcggggagccgagggggcggcauuccagacgugcuagaugucaggagggggacuggguguggccgcugggggagccuccggcccagcagugagaagucccacuucgcuuuccgcacugcguucucucacucuggaccguaacuucugcaauuucaggugaauuuccuugcaacugagggacgugccuuuguggagucggagcaggguaccugggggagguccagggggcaccagaaccucaagucuugacuacugggugcccuucuuuacaaucucaacucagucuucgucaugaacgcuagauugucugcuaggucagcgaccucagacuucauuucuucuggggaguuuguggcucgcuuagaaugugugcagaaggaaguguccccgggugguuguagggaacguugccuugacugugcugaugccaccaugaaucaguugauagggucuauagaaaagggcgugguuccugggccucagguuccaaagcuggcgcggagggcugugguuggagaaguuucuuuaucuaugaaagugguuuccgaacucugcuguugauagcgccacucacacugaguuauugaagguuuccgaaaacaaguucauucaaaaauagcuaaauaaagcguacugaaacagugucaugcaaauguaaaagcaaagcaaaggcaacaaaauaacuguuacuugagacagagccguaaucucaacacucagaagacuggagcagcaagaucccuuuugaauccgaccugagcuacauaguaagugagauuccuguagggggaaaaacccaacuaccaaaaaaaaaaaaaaaaaaaaaaaaagagagagagagagagagagagagagagagagagagagagagagaaaagaaaaaaaccaugagcuuaugaucacgaucaagcuuauugguaauugguagaguaccguaguagguugaacuucauucccagaacuugaaaaagcuauucaugugugaacuauuaugccauauucaacuccagcccuuaaaagcaaccauaaacucuuggaauucaagauccucagccugaaacacucaggaguauaauuaggugggucugcaacuuggacucgggaagccacuucccugcccaaccccaacaaagcuauagaauguguuuggaaucccaagcuagcaccagaaaaagauuaauuugcaguguauccgaguucuggcuaaaggcaggggagcagaaugcaaacuggggagggugaggggugaucuguggguaggaagaauaaaucacugauguggggcucaauuuuuuucucccuuaguucuaaagauagucuugaucaaaucauaaauccuaucaauuggaaacccuucucccguuucuguuuccugcauuccucccacugucuugcagccugugucccuugaccuguuagguuggcuuuggagacuugcagucccacccacuuccugcuccuuucagaguaugaagcacucuggaucugagucagggaacuuggagccagcagaggagaccagggcagagagaucccuguccucuuccgcucuccgaagcacacagcugaucugaaguccaaggguuucuccagaagcacccaucaggucugcugcagcagggcaacccacuaggugcaucucucgguugaggguuuccuguucgguguguuagagguucaggaaguuugacuaacuagccaggcagcacuugaggcuuugacagaggccuuggacuggugccucaauguuucacauccugugucuuugagcuauuaaaguacccuauugauuggcauuaggcaggcagucuuggucauuagcuuccuggcuagucucugcuuuaaguaguuuuccuggcaaggcaggaacucuucuaaauugcuauugauuuuugaggacugugguuucucccugaaccuuugggcccagauuaauaugugugagcauuuaugggaauuuuugcucuaacucuuggcuuguagggagacuuguuucaucaagcaaaggugguuguguuacaaaaggaguaccaggcacuaugggccauuuguuuuacaaacuaucuuguaguauccaugauguccuaaucacagguaaugguacugagaauacacaguggacuggacacacauauacauaaauaugcacacaaugugcacauccacacgcucacacaaacacacucacacauccuuaguuuuuagaugcugaaccuauugggaaagaaaacaagagacaagauaagcgaauugacugggcagauagcaauuugacuugacauuuuauauuuuccucagauuaauauccacucccaaaccuagcugggucuccuuuccuggcuuucauccaguuguuaauagagcugggcuuggaguugagcuuaucccaaagaaguguacagaaucccuggguuuacccugucugcggaaucaacugugagauuugaauagaaguugacuguucucuuuuuuuuugcaccuacaaauaauucccccgaccacacccuucucuagcugugcgccacgagagaggaaauuccaggccuuaacagaaauucuuuccacccauucacagucuggcgugguuuuccuuuuguuaccagaggcagugcccauccguguuguggaggggacuugugauucuggguggguccacugauaugaucuccagauguucccgcuaggaugcacacugaaguuuuuaaaugauccgagcuccgaucuucucaggguacccaucugcagcacuggaguagucuaguuccaaucccagacuugauguggacacucugaccacaggaaugacuuggaaccauuugugugugcccuuugucuccuggccacacccagaggacacucacagcucuaaggagucacagggccacguggaucucccacgucccuucugcuaccuuuuugucgucgucaucuggcucucugccugcuccuguaaauggaugcgaugguucccaugcuguucugaggcagagcuagggccaucucauccagauacuguggagaugguacaaggcgcuuagcacaaaugggaagaggcugcccugagaugagcugcuaggcugcgugaagaugcucagaggcuggaaaugggggcucccaggucugaauggguggaaccaggccuggauuuuaaacacacaguccuggguagagaaaggaaauugaaaaaggcaacuauuuuggaaaugacaaaguagaccuaaaacaggaagacccagugugugaaccaccuacuauacgcuagguacugucagucccagaagucaggagaaaagaguaagucacaugacuggacagugugggaaguguccucuacacacucaguucuggcagggcaggagaucugggcuaggugacaucguuaugauugucuuugacuuaaagucucacuuaaaugcccacugaucaagauggaguguuccugguggacaggcauauaguacugggcauguugagaggagaguuagugaccuagccugacuuauguggagggugcuugugcguguauguucaugugcuaagacuauauugaaagacugguaguguugcugaguggguagaguacuugccuacuggaacaagcccuggauuccauccccagcaccacaggaaaccgggaggugggagguucaagaucacccucagcuacauagugaguuugaggccagccugugcuacagaagagaccucgucuaaagagagaaaaggggaggaggaggagagagaagaaaccacagacuuagagggagggagguucagggugugguggauuaucuugaacuuggacuuuucucuggcagccgagcccuguuggaagccugugugugggcgggccauaggacaccgagauugaauuguagcugcucccggggcuucggggcuucgauccucaagccugaacguguuucuuccuggauggccucuuuccaccagcuccaacucuaucagcucccagggcaacguggcaguguguguagcuagcaaacaaauauugauucagaucagacagccagagggacggcaagcacuggagaggccucuucugagucugaucaaggccaugggcagaauuccaggagugcuggggcuuaacuuggcccugugacucaagcauuaaucagaaccauaaaacuaagggggaaaguaugugccuucaagaagguucuguuaaccagagaugauuuaacggggugaagggugggguagagugggaacucccucucccaucauucacgcguggguuuuuuucuuuuaauuguuguuuaaaaucccaguguggucuguacacuucgauguccaggaccuacaguaagggcugugguggggaaacccagcccuccacauucccacccccacacauucuggcuuuaaaauccugguuugaggucauuccauucccugauugacucaucgugguggugguugcuaggcaucuguuuugggguaacccaacaacagacuugucuuuuuaacuacucuccaagugggugugucucugaaacugccagugggugugucucugaaacugccagguuggauucccuacaaaccagcccugucaagcuccuggguuugguuguuggguuuuuuuuuuguuuuuuguuuuuuuuuuuuaaauuaauaucugggcuuccuggaacuagcacuuuuuagcucugugaaucuuauuuuuacuguuuccagcguugccugugagauucuuucucucagguuuuuugaaaaccucuguuugguuuucuuuuugcaggagagagguuaaaaagaacgccauuuguacuuucuggucauuguuguaacuaugguuuuucgaacaaaacaauaaaauguaauaagaucuagauauuaggguuuuuguuuguuuguuuguguuuuaaagacaaaccuauaaauuauuuguaagcagacugucuguuacaggcaaacgacugccuggcugaccuuguaagagcaacgcagauuguguuacugccaagcuuugccccugagagccuugagccaucagguuaagucucauuuacuaauauuuucaaggccacaggagacacucuguucccuucauuuagggaggagcugaggcaggccuguuuucccaccaguggggguugggcagagccacuugagauuggcuggagggguguguagcuuucagucugccaggacuuggcugguuuauuuucuuaagcaaaaacaccugccugagaaagggcccuuuucacaguguagccaggucccagccugcuuagcuuagcguucucuagcagauggcucaccagauagcucuuucugguaugcaggcugaaacuaguuggccagcuucgugaaguugagguacagggaagagagaugcaguuugggggagcagccugccagaaggggaggguggcugugucuguaacuaagucacccugaguuuuacauuuuggaggagcuccuuaagacagggucucacguagcucagguuagccucaaacucaguauguagacaaagaugaacuugccguccucccaccuccacugcuaagagcugggauuacaggcguggcucuucacagcuggcuuuuguagaucucuuuaaauguuggguuuuggugcgugggucaauacuaacugguacuggucuagucacuuuggcccucccaccuuccaccguucuguuaaccaaacuuaacuuugcaccauuugcucgggcccuugggcuuuagagucaucucauggacauggcuuccuaccacgccuguccccuuguuugccugagauacgauauauaugcugagguauguauuccuccacaggguccuacuaucuccaucccccgaugacguguuccucuggcugaugacucgucucucucagccuacacauagaggccuccccauuaggcccucuacuuccuagaucuuugugauguuaaacguccauugaagagucaucagggucuaaagcgcaaaggcagaggacucaaaggucccugcucuucugcaggccagggcuauucucuuaagugucucucauacaagugaucuauuccuuacuucucagguuccugugacuaaauaccuagccaacuacaagcccgugaagggggcggggcuuacuucaccuuauaguugacguggauacacuguaacggcugggaaggcagggaagcaggagcuugaggaggcagcuggucacauugugcacacacaggccggaagcucagagagaugaaagcugaaucucaggauacuuacugucuuuggggauuuuuguuuguguuuuuuuguauauaguuuaugaccgaagcucacgacauaguaccacucccauuuaagaugggucuucccauucuaaugacccuacacuaggaaaucccucauaggaaccucccaagaugcguuuccaugguaaacggaaaucuacugaaguucaacagugaaccuuuuccaugacaggagggaagcugagggugagaauucuucgucucuucagcgccaugucagugugugguuauccggaguuuguggaggaucugaccauuaccagagacuucacuggcacugcaaaggccuuugcugaccuggggagguguaacgcacugacccauucucaguaaucaaacuagaguuuuagcaauccuagugagaagcaaagcucacucuguuucuucuagcaacgucccuauugcgagacacugcacagcccggggugagguagaggagcaaaggcuguguuuuaucucuaagcuaaaauaggguugccauuaaacuugcaugagauaggaaauauuuaugggcauaggcacuuacauauugcuugucagucucugugacuuugggcuuauuaugauauuuuuggauuuuuuugguacagaaugguugugguguaaauguuacauauuaaaacccccucuugaggucauguuucggagcuaauagugaagagugcuuguuacgcaaugagaaccaaacuucacaucucagcacaaaggggcucucucauucagauggacuagugagccaucuuucuccagagagcuccugucuuugccucuggaacgccgggaucacaggcggacugucauauccaccaggcuuuuaggugggugcuggggaucugaacucuggucuuuacaccuuuguggucaguccuuuaagccacugagcaucucuccagcuccaugacacccuguugugaggggggggggaaaggggugggagugacaggagccagaaaguaaaccaauuugccacagacaaagccaaggcaagcagcacuuuuugaguacuaaaucuuuuucccaggaauggauagggggagguguggcugacuccugaugcugaucucugagggcugugcuccccuggagucggagggagcaguggucuugauuucuuucuuuuuuuuuuaaaagauuuauuuauuuauuauauguaaguauacuguagcugucuucagacacuccagaagagggcgccagaucucauuacggaugguugugagccaccaugugguugcugggaauugaacucaggaccuuuggaaaagcagucagugcucuuacccacugagccaucugacaagaucagauggggagauugaguugguagccgcagggaggagaacaggugauuauaaaugcuggcacagaaagcaagauuuguggggcuccccaaaaucccccuuauuuguccucucaaggaguuggggcuaugggagaagaauuaaccggaacggagaguaugagguaguacaucagauugucuuugaucugcagggcacuugggggagggcagccauccgaggagcgagcaggacucagagcugggcagacagccgggaagaacaauucaauaaaaccuugcuguacugcguagcugaagucaccuggaccacagagcugggggguggucagcuaaggaagacaucuguauaggcuccauaaaaggcuuuugggggccgagauuggacuguggcuuucuggaauuccuguagaccagcacuaauaugcagagugcuaguuucacuuuauucugacaaagacacagaaugugagcugcauauaugauuuuucucuuagucacauuauacaacaacaaaacgguucagugagauagcuuugcaaggaaaagauacuugucaccaagccugaggaccugaguccagugcuugcaacccacauaguggaggguuagaaccaaccacaaguuguccucugaccuccgaguguaugccagggcaugcaccugugcgcacacauaaguuaaaaacauuaaagcauacuguuaauaguaguaauauggagagagcuuaaggauaagggcucuuguuuuucuuacugaggaucuugaguuugguuccuagcacccacaucaguggaucacagucaccugaacuccagccccagggaagccaucaaccucuucuggccgcuguaggcacccgcacuucgaaugugugccauugacaagugugucauauacaccaccauauacaccauauacauauacaccaccaagcaucaucucaccgucuccauagagcugccucuucuagaaugcccuauaaccggaaucggccaucugcagcucuucagaccaguuuccaucgcucuggaaugggcaucuaaaguuccucugugucuucugagauggaaaauuuuuuuagcaccaaauaauauuccuuuuuuggggggcgggggaaggaugcaccacaguuuacugauacagcaagauuuugacacagugaggaagcugagggagugaaggucauuuaaaagucuuggaugagcuuccuuuuugucugguuuaaaaggcuucagagggagagagaaggagaggggggagagggagagagaaggagaggggggagagggagagagaaggagagggagagagcaucuugcaagaagugaguacaucuugaccaugaauagugcugaucucuccccacccucccaccucacacagccuggaaucugugugguucagaacgccccuguaagcuggcaaauggcuaggucauauauuguaauaaauauaacauauuauauuuauauauauauauauuuaagaaaacauuuaggcaaagcaaguuccuugaacagaauagagagcuuaauucccacaaguaccaagacaacugcuuggugcaaacacuguuggcaaccuuuugggggagguagcuguuucuuuucggggugugugugugugacaaugcagaaugacucaucuugucucaguaguaaucagucuugguggugggggcugggcauguggggcuauccgucccaagaacuuccuccacaaauagguaaaggccuuucaucaggauagcaguccugacugcugaaguguauuuaggggacaaugaugacauugcaauugcucuaaaucuuaaaugcaagaucagcccucaaagagauguguucauaucagaaaguuggucuauuugcauuuuaagaacaguuuaauaacuucuuugcguauguacgcaugcaugugcauauguaugggccugggugcacuugugaguggaggucagaggucuccucaggugguauccaccuugcuuuuugaggcaaggcucucagugacuugagccuugccaauuagguugggcuggcuggccgccauggagccgcagaaauccacccaccuccuagugcuucaagauucccagacuuuuucauauggguucuggggagcgaaccaaggauuuguacuuauuaggugagcguguuauagaugaacccauggccuagccccugaaucuucugagugucacugggaaaaacaguuguggggcuaaugguaaaagauuccguuugggccaacauggaggcacuauugagcccaguucuugccuuucuuacaaugugaagucacuugugagcgacacacaagucauggcaguuuucaugugcuugccacuuuuuuuuuuuuuuuuuugguuuuucgagacaggguuucucuguauagcccuggcuguccuagaacucacucuguagaccaggcuggccuugaacucagaaaucugccugccucugccucccaagugcugggauuaaaagcgugcgccaccacgcccggcuugugcuugccacuuuugauggaagaacauguuuucuguuugaacaagugguguuugccacagggagcuuuuagcuuuuacauucgcaaaccagaauuugccaggucccguuuaaccagaguaagagacagagcagcuccacaguccauccccaaccuaagacacuucucuaagcuuuaacuuucccagugguaagacagagaauugccugcuugaaacaagcacuugcuuuaauagccucagaugcaaugguccaagaagacauuagugugaugaauugcugugcuucagggaaaagaaggguuguguguguguguguguguguguguguguguuuuaauaaagacuuuguauuuuuuuuucagcuuuuuuuuucuucaaaaugucuacuguccacgaaauccugugcaagcucagccuggagggugauguaaguuuaucuaaacucacuuugugggauuucgcaaauugcacaucuguucaacuguguuacaaucuugcuguguauacaaagaaaauggggcccauaauucagucauuauuaggcgucucccuagugccuggguuccucauugcuuugacuguucuuagcaauuuuauuugaaauaaaugucauggugcuaaaaccuuuuuuggcaucgaaugagacuuggacagcaucuuugcaaggaacucuuugcuggaacuguguuuuguuggacuuuuacugcaucugcuuugaugucaugcugguucuuaaugucaacccuugagguuuuauuuaucauaagcuucaagcaugucaaaaaacaauucuuaugucuuuuucuuagaauaucugcaguauucuucuaggcaaauggcuuauuauuauuaauauuauuauuauuaacccacugaguugagucagugcugcccauaugugcaugggucuuugucuacuggucuauggaaccuauucauggccacauccccaaagagaagugacucucucucaaagcaacugccaaccacgauaguuccucaguuagaguggauggaccucagaagccuuggcuuuucuguuuuuaaucuagcacccgggaaaucuuuucucuaaaauaaaucagaauguauauuuuuaaaagaauugaauuaugucauuaauccuagggcuuuguuguuuuccucuugucuaucugggagcucagaauuaaaauuugucuuuuaaagaaccacucaaaagacagaugacaacuugggucacguguacaagauccucuguguugucuguggaaccugcucucauaaugugcaagugaacgggccuguucaaacacagacuguguggaauauuaaagccucugauguucccucauuuaaaguccggaaccacacaccacuggugaauccccuacacaauggcucuugcuccugaaaugcccccucacagccucccugguacaaacaacgagugguguugucacaugcugaugacguucaaccucagagcagcuccuauagauagucagcuggcuguggggacaucagggaucucugagccagcccagcaacacaccauuggguucuuaguaaugaagugacacauggaagcaacugaggcacacucacaagcgucccucaggauaagcuaggacucuaaguucagagucagacaccuguuaaugggggccaaaugguaaagcugguucauauuuauaguucugaaacaacacaaaugcauuaacaaaguugguccuugccucguuuccaggcaugaccaaucucguaacauaacauuaccaucuacaauguucacuguagcagaauucuagcagaacgguuacauguggccugaaucuggaaugauggcaccgaggauuuggaagggggauguuaaaugaguagaagagagaacagauagagaagucagccauuagcuuggggagugggcagaggcucccaucuaucagcccggaaaaguaguuggcucugaugggcuuccaaaaaggaaggacuauuuauaagacaauaaggaaaaugugccagcccuguaagcaggggguauccuggagaaggcagggggagcacugaggagguggaacagagaggaagaggaacuugucacaguaaggaggauguggcaccaaggugggcauucacagcacagugcuggaggaagucccuucccuugcacagcucagagagcaugcacauuggacuucugauucaucugccuccacuccccagugcuggagcuacccuuuccccgccccuacacugcugggggucaaacucaaggccucaugcagcugggacacacacucuaccaacugacccacacccccagccccgcauccacuguuuaaagagcaggagucugggcagcacaggccgguagugaaggcucggcagugcacacucaucuuccaggcauuuccacaguuugaacuuaguucaaauucuugcuagaccacuuucuuucucuucagaaacucgacuagguacucaucccagauuuccagcuuggugcccucugcucugaagcucccacuacaaauaaaaugcagaggggaggcacagcagcaugcucuaaacuaguggagccuuugaaggacagcucuuuguagaagcaaguaaacuucuccuccuccucuucuuccuuuucuuccuccucuuccucuuccuccuuuuccuccuccuccuccucuuccuccuccucuucuuccuccuccuccucuuccuccuccuccuccuucucuccuccuucuccucuuucucuccuccuccuucuccucuuucccuccuccuccuccuccuccuuucuucuucuuuuggauauagucucauguagcccaaacuguccucaaauucauaauguagcauaggaugucuuugaacuucugauccuccugucucuaccuccagaguguuaggauuacaggugugggcuaccaagcccaguuuaugugguucugggagguggaagugagggcuuaguuaugcuaugcaagccuuccagcuauugagcugcauucccaggaucaaaaugaaccuucuuauauauauuuuuaaaaagacaacugguaugugauggucuguggacaccuauuuacuuaguaugaaagagguuagaaucaugaagaggagugagagcacagaaucggguuucaaaaguguuguuucagugagagggugugccugguuuaauuugauuguaucuguguucucauugcagcauucuacacccccaagugccuacgggucagucaaacccuacaccaacuucgaugcugagagggaugcucugaacauugagacagcagucaagaccaaagguaggcauugcgccuugucaaggccuucuccaugucagggcggccuuugacucguauugcagcugagucacaaccaccggugaaaguaucagaugccuuuuucagucaccaccacccccaccccacccuacacuacauacgaucuauuuucuuaaaacaacuccucuuucacuauuggacacaccuagauucugugguuucuccuuuguagaacauacccugcaaguuaauaguuaagucauuugacaaagauggugucuuuuacaagcuuagcacaaagggugcuuuguaucccugcaugagaaagcucuuagccuacuggaauguaaagacugcacagaugaacucuggccacagcugauacucacacauuaauaaaacucacacuuccuggccuuccccgagucagcagaaaaacacuguaguucccuaagccaagaaaguccugaggcugagccaugggccuccacauuccugugugggcaggaguggcugacgucaucaccaccaucaucaucuuggucgucuuuaccaacauuuauuaagugcucaccaggagcagauacugcauugagccgcucugaagcuuccugcuuagccgacccucagacugauuucagaugucaugcugugucauucccaauuuacauacggcacaacugagagcuagcugguuaacaugcuucaugucugcuggccuugguucuuacuuggaguuggacauaguucugcgaugcagcagccagugguuaggauuagacucauugacuuagagcagcaucuccaggagugaaaaccagugugcagccugauccugcugccaucggauacccaccacaguugugguccagcacuagugggggcaucugugucuuuuugccuucaucccacccaacccccaucacuuagugcuccauguuguccuugacuuuuugugccuagugguuuuagcgaguaacaguuuucuuaagucuguuccucuuuacaguauaagauuuaacauguaauuauuuuacguguauuuugcagauauuuaucuaccaauguuggcaguuuaauaugcucauuuuaacauucauucaccuuaaacuucucaguucugcagaaaaaaaugacaaauaaaaucgaguauaucauauguuauuaugacaguuacaauuuuuuacuuaaaagggggaaaaucaaaggcauugguaauugaauuaugaaauuaugaauuauugagucuuaugcuuucaauauauauucuguuucuguguuugccaaauuauccaugauggcuauggauugccuuucuagacaggcagggcaaacucauuaaaaacaugccccugggggcuggacagauggcugcugcuaggagcacugacugcucuuccagagguccugaguucaauucccagcaaccacaucuaucuguaaauaggauccaaugcccucccucuucugguaugccugugauagcuacacuguacuuacauacauaaaauaaauaaauaauucuuuuaaaaaaugcaugccccugacauuucagauaaguagcaccacuuagauaaugagcugacaggaaucuggagugauugagacacucccgagcaccuucgccucagaucaggagccugcuuuaucuugacaucaaaggaaucagagguaaaccuugaguguccguagaaacacaaaccaagggcugaaggauggcugccaguucccuguggccuugcaucugaugcagagguggugagcugggcucuugcaggcuagccagagcgaggaggggaggagcccggagccgauugccuggggcugaauaauugcugugaaaucugaggacugggugugggaggaggcucgacuccagcgcaguuaggaggggcagagugcacagagaucuggcucugccugguaacuccucucccagcgcccgccugugagaacucaccuuugggcauuaugguggcucucuuuuaaacaggauugcccugcugcuuccucuucuagcuucuucuccuauuccauacagugcccuaagccagcccuucucagccagaaagucucgacucccacaggggucacauaucagauacccugcguaucauauaguuacauuaugauuccuaacgguagcaaauuacaguuacaaaguagcaaugagaugauuuuauugucugggggucaccacaacaugagaagccguguuaaagugucacagcaucaggaagguugaggaccucugcuaagcagauggugggugccucugccuuugcuacuccagagguguggaacuuuuuaucccugagucccuaacaauugccaagcauagcucuacuccaauacccuccuuccccacaccccagacauggucuugcaguguggcucaggcuggcccaagcuuuugaucgucuucccccuguguccucaggacucccagugucuacaccuguguagggcugaucaccucagugucuccuggguuuccacuucaugucuccaaucuccuucuugucacaaugcuauacuuacuaacuucuagaucuuucuuucuuuuuuuuuuuuuacaugguuuuauuucuuaaccuuuuauaaaugcccagggccaugagguugugugaggagauuaaaccccccccacauagcauucaaaagguguacaggugucagagcacagaggaagcacagaugcacuucugggacggggagcacagguucauuacagggucugggcguugccagaaaagugaauagucccugugagcuuugccccaccuucaccagcugaauuuagcuccgacuugugagccaacuucuuccauucuagucggagggauagugaauguaucuucuugcaucaacuaaacccagggcaugguugcuuuguauuuacucucuggcccggagguggacggugcaauaccuuauguuaauuuaugucugguuagaagcugaguuaagucauggaaaaguaguaauauugcuuaauuaacaagagguuucugagacuugauccguaggagucucuuggucuagauuggccuuggguuaaauauauacuguggaguguucaacacagcuggggaugguuuaccauauggguccaaauaacuagaaaggaaagucagcuaaauuagaaaaggaugaaucucaacuccaugaaauagaugguaauuagcaacagcacagcccuggaguuagcacuggugccagugaaucugagcagcuuuggcgccugcagaggggagggcugggaguugcucuauuauugccaguuuugauuugagcaguauuuguguucuccggaagggcgagcccccacccccaccccugcacccccgcuucuucaugagcaagcccaacuauagaagugaguuucugcacuucuuuucucuuaacauuuuaaaauagaaccaccuaagauucccagcaaggcuacaagaccacucuccuccuaugcagcggagaagggcagaacgucuuucuuguaagauuggggugccucugugggcugcaccccauaaagaaguccuucauaacucauuggcccagggccauauuguucgacuagaagggaaacuggccccacucuucccuuugcagaggccucucgcuugaggcuccgggucacuuugcaaaccagcccucaucugacagcuguucucagagucagacccuguugagccuucacagcugcuuuaacuccugagcacagcauuccugucuaagagcauugucugcauagcugugcaggaaccagguggcugcaaagcacuggggagggagugcccagggcucuuucauugcuggcuucauuggcugccucucccuccucagcccuuucuuuuuucuacugaggggauccaaaaaccaguuucacccacgaacguuggaagaaaccagauucuaaucuggcaucugcacggugggcugagugaagggugagccugcaggguuccguuguugcagcuguucagguuuuuccuuuccuguucucugaggcaacuaggguaccagggcauaaaaaggugcccacauuguacacauguuacuccauuuuuguuuuuuuguuuuuuuguuuuuauuucuuuguguuuuccuacugguucuagguggaauuuuagaaacacacuagauuauucucugagaauuagaagggcuuuuuuuuuuuuuuuaauuauuuuuaagucagggucucuuguauugcagaacuugccauguagccacagaugacuuuaaguuucuaauccucugguucccaccucccaagugcuaggauuacaaggaugugccaugacacccaguuuauguggcaccagguuccaaacucaggacuuacaugcuagacaaccauucuaccuacugaguuauacccccaagccuggguuuuuagaugacaaaugcaucccauaccgauaacaaaggagacuaggccuuagguccuaucuaagaaaccuagccgaggugacaucagaacagaugggaauagaaguuugaucuuugggcuaaagugcuuucuuggguauuccguugagcuaggccauccuugaacugggucugugucccucaacuauagcacaccugucagaggccugaugcuccucagccccuccccuggguauccaauucuugucucagcuuucaggaguuucuguuguucaccuggaaacugcacuguuaaccucaugaaagcuauuagcaaacacggccugggcuucucucugcccugucuuuucauaggccaauaguugaauccaggcaguggcugggucuggggcugagaggccaagggagggacuugccucccaucauucagucagucuuuuuuguguccuagcaacauaagucuuacgaugguuccuguuuuauaucugggaaagccaggugcagagagagaagcauugaaccccaaggucguauaugcuugagucucagguacccuucagaauaucgccuccucugcuuacacagagaccuccuguauucggcacugucucaucccggggccaaaaugccaaacaaaagcgaguuaagggagagaggguuuacucuggcucauagucggauagcccagccauagugcaccaggcauggagcagagcgaggaauacuggugcuccccucacagugcuccauuuuccguaguccaggaccuccgccaaugggauggugcuguccauauuuacagugggcuuucccaccucagucaacccuaccuagguaacccuucacuagucaugcauagaaguuugucuccuaggugauuucagauccugucaagucaguaauaacaacuaucacaguaucccugacucccuggcccgguccucucuggcauacuuuaggcccuuuugugaagacagaggauuucuucuaagccaaagauaucaaagauagccagcaaucugagcuguaguccuauccucccgcccccaacuagauaaggcaauuuuccuuuucuuuccaaccagacagcucccaccccgaggccucuugagcccucaucagacagacagaaucuacucuaugugcagucagcaugucucugguguugugaaucagcauccuguuccagaggguucuugguucccugccagagacaguggagacacgcauucuccauggaaugccgaaguccagagcagaccaaggauuucagcccgcagagaggaagagagcaggggcgggcuuuguggguuuggauucaaugcuugaaaccuuuuaaugcuugaaaaauauggugggcagcugagaagacucagccccucaaagucacugcuggaacucagcugucaguuaugcaaagaccucccucagguagacucugcuuagaacaaugauggaccuuuuuuuuuuuuaaccaugucuucaauuggaauauugaaaauaugcaggugauuagacuagccaaccaucuucauccaaggacaacaugcuuaacugcgacccugcacccgugugucacuacaucuugggucuuaguugggcuuaggccacuugacuucuguaaaauuugagucuguuggauaaguuuuuacaaagaucaccugaguggggcccagcagguaagaauguuugcugcucucgcagaggacucaaguuugguuccuaguacccaaguugagcuauucacagccgccuguagaugcagcuguaggggaucuguggacgcuuucgucuggcccacagucucuuuagaucucagauccuucuaccuagccaguccuuccuuaaauggggggaagugagaaguuggaaagaacccagugcacggaugcagagccuuaccugcuaagcuucuggagcuaaccuugaaggcauggccgucaguauugauuacaaugcccaccuggauggcugaguguuugccccaccuccuucaucuguaguuagacugugguggccaauggccgcuuggucccugcagcuucaagcuaugcuggauaguuuuccacaggaacaaacuguuucauccacugggacaucaggucaaggaagcaauaguggucuaaagauaacaucaccgggagagauggcucagagguuaagagcacugucucuucuuccaggggucccaaguucaauucccagcaacugcacgguggcucacagccauuuguaaugagaucuggugucuucuacuggauugcagucauacaugcaggcagaaugauguauacauaauaaauaaaucuuuuuuuuaaagauaauaucaccaauggguauucuggugcuuuagcauagguuaugccuuaugugccagcucaaggcacauaagcccagagaaugcugggcuucuugagacaugccagcaacuaccugugacacagcacugaugcagaugaggguuuagaggguuuaggguccagagcugcccacuuguagaggaucucuguucaguuucucugcauugacugucaucagcaugauacugcgaaaccuuugacaaaucugcuucuagauccagccuucuacacagauccauccauauuccuuuguugguuuugcuuguuuguuuuucgagacaggguuucuuuguauaguccauacagcuuuaaucucagcaggcaggaggcaggaggcaggaggcaggaggcaggaggcaggaggcaggaggcaggaggcaggaggcaggaggcaggaggcaggaggcaggaggcaggaggcaggaggcaggaggcaggcagauuucugugaauuugagaccagcugggugaaucccugucucaaaaccaaaaaccaccaaaaaacugaaaaaacaaacaaacaaaagcacaacaacaacaaaaaauccucaaaaaagaauaaaaauaauucaccuugcuuuauuuuaaaugaccacauacauagcauaguauuccaguguguggacaaaaugagauuauguaaucagucccuuauuggacauacaagggugauaauccguauccucaaacccaccucagugucuagcaauaggguauucacacuguauucacacuguauucacacugacuacucuaaaaucuaaguggagugcuagacauuuauuaguacgugaccccacuuggaaaugaguacaugaauguuuuaaagcaucuuucuuuuuauacccggaaauuaucacguuguaaaugcgcgugaagcaucaggaugcuuccacuguccaacuguucauuguucugccgcccaaacaucauaguucugagcuccaagugcuuugggaugccucugacuuucuguaagacaaguugggugcagucuguaagugaccuuuugugcuuagggacucuggaauugcccaccagucauggcaaaggcuuuuccuuuuauugagcaaaguucauagucagacagcggaaagcucucuugcugccugaauccucaaaacugagcuuugcugaguuaaaugacaugugaggaauauuucugauauaaaaauuggaaacuuucagauaccucgaaccuugcuuaucuuuguaaauacacauguuccaauuaaaauagguacugaaacauuuggguggcacuucaaaacucccaauuuagauuuaauuuagauuaaagcacuuauucuuuuuuaauacaguuguaaaauugauuauuaaagucaccuauugaagauugaaagcacaggauguauacuuuccuugugagacaaucucaucuucaauaagugugguucuauuaaucaauuagcuauuaaaauauaacugccauauuaagccugacucauuugucaugacagcugguauaauuauaaaaauuauaccuagccauuuauacagccauaaucuugcaauaaauauaaauaauugucucuauuaauucauuuugaagguucugucuauuaauucuccaguuaaguggcaauuuggggaccuucauuuaaaaucuuuguuguucguuccaucugacugccagaguuccacacguguaccucccacuguugauuuuggaaaccaauuuaugaauaaaauagcuuuuuaagugcaaauauuuaaaggguugaggcccaagguccaaggcuuucuggggaagaagguaaugagggugccuguguuuggucaggaagagggaugagcuagucgugacauucuaguauuggguuggggagagaguauguggauuucacugugugaacgucuccuaaagcguguggugggguaacuguucauaacuugauucuccacaggaguggaugaggucaccauugucaacauccugacaaaccgcagcaaugugcagaggcaggacauugccuucgccuaucagagaaggaccaaaaagguacuggaaccuuaguguggagggcaggccuuguugaguuaauguucucagauauugccuguucuguucuuaauuaauaugugugugugugugucccuuguuuguguugcccugcauaccguaggguggcaggcccuaaagcuuccagaugauuccccugucuucaauuucuaucuugucacagaaaugcuggggauaccacaucuggcuuuuuuuuuuuuuuuuuuuuuuuuuuuuuuuuuuuuuuacauuuagcaccauuaccugcuaacccauucuccaccccuaccccguccaacauuacuuuuucuuuuugugaguuguggaucuucuuuaaccaaaaggauccuucuagaacucuuggauguccaagguuucccucuuauauccuugagaggguugcugcuuucauagguacagccgugggagguagaauggaaaggugacauccuggaacacacgagggaggcauucuggaauagacgacaaggaagagaagcaauggucccacggguuaugugcugacucugucauugcugugcuuagguagcaacucacuuccucucauggcuucucuggcuucuucgucagauguugugaauguaauuucagaaugguuuccuccacugggcgugaguccuaacgugugcuucucauuuacacugaggggcuggggagacagcucuguugguaaagugcuugucacacaagcaugaguaucugaguucaaucuucagcauccacguuaaaagagcuaaauaccccagugcuagggacgcuagauaggauuccuggggcuccccagacagucaauuuagcugauucagagagcucuaaaucucacacacacacacacacacacacacacacacacacacacacagcuucuuuaucagauucaucguggcugaagugcugugguccagccugcuaucuucaauaggcuucgcuccuaguguuuauggaguuuucuguguguguuuucccuuugcucguccacucguggcuaaagcaggccccgucuuguccaccuuaguuucccacagcacuaggacauuuuaccuuuaaggauaugcuacuuaaucucuaacgcuuugcuauuaaaagcuuuugacuuauauucggacagugccaucagggugaccucaugcggcucccgccugacuugaggcuuucacuccccgcuacaguagcauugaccugaaagaaugccaggagaaacugugugucccuggaguuggcgugaccaccagguccugggaguuccaggucaagccuggcugaagcucuguccuccgugcuccaaagcaguugggaaaggacguaaaugggaaagcagcuagcucccuucaucccacaugcauuacaauucuccuuucacgggaugacguguguuaaucuucugcagugaggcucagaagggaguguuuuaugucucuggcugucccaaaggaucugagagcugcaagagccaaguucccguuggaacaggagauccacuauucuggacugaaggaaauaacugcucauucaguguggccuuggaacugugugugcacacugagcuuggcuucauguuagguagcuggagaacgcagauccugcagagccuguuggaguaaacacauuauuagaaucaugagaagggucagcaaacacacaggcauuagcgcgugcuaaggacagcccacugcccugaugauacuuaaugguccagggugauuaucugucacaggaagaugccgcaacugccugagguaauuuucuaaaaggacguccuaguauuguuuuaggugcacuguuugucaagacuggucugcagcagugguucacagucugugggucaugaucucuuucagggguugagcaacccuuucacaggacucgccuaagaccaccggaaaacagauguuuaccugaugacucagaguagcagcaaacacacaguuaugaaguagcaacaaaaauacuuuuguggcugggaucaccguggccuuucugaccaggacaaagaacccuauuaaaggguugcagcacuaggaagguugcgaaccacuggucuagagggacagagggacccugcccagguggugagcugcugcagauacugucacagcuaguaaaagagggacacagggaggaaguuugcauuuuaugcuuugucccuucaaacuagugcuagacacaagguuucucuaugcagagaacaguuguuguucuauugaucccuucugggauuuuuauuugugcugaguccuauacugggcauucugagcaauucaagucaaaguggaaaaauccaguaggugccccagauguccccugaggugagagcagagaugggggugggggcgggagggggagugucaaggacagaccaaguugggagucacuuaaccucaggguuccaauuuggaaagcugguguuauaauugguauguguuguuuuagaaagaccuuccuaccucccaugcaugguuagggcaucagcagccagaaggaggaggugaaugggcugggccuaaugcuuguucgcauccaugccaggucugacuuucuugacacuugcuguauguuaccuuuagaggcuuguggagccucagaaauuguuggccagccagccuacagggccaaguuccaggccaacaagagaccuuaucucaaucagaaaguggagggcaccugaggaaugacaacuaagcuuguucugugaccuuaacccgcauaugcuccuacacacacacacacacacacacacaugcaacacgcacaccccacauaaaaauaaaugcaguucaguucagugcagcuguggccuaguccauucccauggcuggugaguauccagucgccgaggaaauaucuuuaagagccacccugaauuaaggauaucugucuacauaucugagugcugccucagaccuccgacuuuauuaaaauuguguguucaugaugauaguggcgugaugaugacacuguccaacaggaaguugaaagggacucugaggggcuggaguucacaucauauucaucaccgccccaaccuggaggagaugggagauggcucagggcgaggugcgguguuuuacauagggaaagcucagcacccucccccccacccccggccucgcuagcacagcuagcuccaggcuacaaggucccacccuagagcagcaucacaaacgccuucccugggaccucuauagaccugcaggacuccacuggucuuucuaccucacuucuuuucagcuugacuuggaaaucucccugagacuccacucuuagcucuccucucaggagcuaucagcuacagcuaccuagugaucagccuggguguuaguggauucccuuaccaugugguuucugcccuccuggucugauguaggggacgaggaaguucuccccaaacggcagaguggucaaagacucacacacagccugcuuuucagagagagccaucuuauuucugucucgcugguuccagaguggacguugguuccaagcagcucugagacaucucccuuuuacaggagcucccgucagcgcugaagucagccuuaucuggccaccuggagacggugauuuugggccuauugaagacaccugcccaguaugaugcuucggaacuaaaagcuuccaugaagguaaacacguguggggugucauccgucaaccugcccauuagcgucugugaauuacagccuuuugaguguaacuaggugauugucaguuguguuggagucuuauuugaagucauuuccccccaaugcuauaaguugucaggauuugaaccaaaaauauuucaaucucucucuuuuuuaacgacggcaaagaaauuuccugaugcuuagcagcuuagugaugguuagcagcugcugagacucggcaccugggcgauuggaaugccucuugggaaaacugcuuccuugauuacacuuccuuuuuaaggaggauaugugugguauuaaggagaaagaaaaacagcuuuuguucaguaaagcuugcagauucugcccaugcccuccuggaugcugcuuccucuggcuucccccugcccccccccaauccguugcugggccaaaauuuggauuugguccaaaaaucagcaaugcagugcaggugagggucgauaucagggugggacuggcaccugaauccaaugggaaguuucugcaggacauaauauuguuaucuaaguuuugauuuugcaaagcuauuuugaacaugggaauugagguuaaauuaguaaauucuaguuuagaaacguccuuggauuuugugcucaccuaagcuacccaauauuacucaaauguaagagauagacaaaugucugccacagcaaagcucagggccccuucucuguguacuugugacauguuggauaaucugaggcugcccucugcugguacuuuuugguaaggcaucuucaaugaggggaagcuguaugucacccuguuggguugucauccuuucuggagaacacacuaggaaugaggccccuucacacauagaguaccaccagaacccuggaacugauagcccagagccacuguaggauuugucaaaucucucucugucucuuuuuuaguucaucagcauagcucaaguggcauccuaggcaggcuguacugcagaggagguaccagucagugccgugacacaccaggcacagggugcaggcuaauaauccuagcacuccagaaguggaggcagggggaucaaaagcucaaggaaguuuaaggccagggugggauaucugagaccuugucuagagagagagagagagagagagagagagagagagaagaagaagaagaaggagaaggagaaggagaaggagaaggagaaggagaaggagaaggagaaggagaaggagaagaagaagaagaagaagaagaagaagaagaagaagaaagaagaaaaggagaguguacuuucaugccaacaacagcuuugaugauaguagcauuccugagauugccaagccuuugggccauuggggucauguguaagccaauuuuuucccagguuucuuuaacuaucaacacuuggaucaguucaucuuauuuuugucaagaauccacuuaguugagauuuaugugauuucacugguaucuauggucggguauuauugacuuaaagcagaccugugugagcugucagucacuccacuaauccaaguaacuggguccaaugaaaggcgcuuuaacugcaccaucuuugaccagacgccagcucuuccauuagcuaucaugguugagugacucuuccgaagaucuucaagugacguuagcaaaaaugaugcuuucaaaaaaaaucuguuuucacaucgggcaauaccaguggcaguguuuugccguaugucacaggagagguuggcccugugauaagaauuauucuuaagcuguggaaagcuugggccaaguuuuagaaauugccaaggucaccuuugaaaguggagauaaagcccuauuagacuucuccgaugugugggcgauggaaggcgagauacugugcucggcucacuuucccucggugucaggacccagcauuucuucugacacaugaguuagacuuuauuucugucaucuuugaaaagccugccucucccuggaaauacucagagaugcuccgugaccaucucagcacaccccuugagagguucagagugcuauguagaccuuuggcuaacaagggaaggauuugggguuucacuggaaccugugaaaaaaacuaugauuaaaauccuggggagaagagucaaagauuagauuaagacuaagauucaaaauuaacuauuaacccggggcuuagcuuagauuauacaaggcacauuuuaaaggggcaucuacucucuaauaaguuuaauuaauagcugacacacuuuucauguggguaaguaccuuucuuauuguauuaacaccuuauaauugauuuacauuuauacaguuguaauucuacuuaguucaaagugguaccucuauauucgcaaagacauguacuagaagacccuuguuauuaagucuugacuuugaucaggaagccagcuuugaaauacacguuucauugaguccuuucaagcucccuagcacgcucaaaaguguauauauuaaauucaaauaucccacucauuaaacucucauuuccuaauaaagugcuagccucuaggcuuauuuggcacuuuuguuauuccuucuuccuaaauacccgaaaagugcagaguaaucaagcaaaaauggaaguaacaggaugcauuuuuuuuaaacacuaagccauuuuugcguuucaaagaagagaggcgaauuuucauccuaacuagcaccuuuccgcuaaggagauguucuaaucuguggcagcugcugacagcggccccacaccacuucuuggucaaugaagacaacuauuuccuguuuauuaaaauggugggugguugagauaggaacuaagaaagacagauaucgagucggaaccccguggccuccucuggugcucagggauagauacuacaaggcugucucuucucauucguuuuucaaaaacauaguagaauauagauguucugcuuacaacaucuuggaaucuggugaugugaaaaagaaaagaaaagaagagaaaagagaagaaaagagaagaaaagaaaagaaaagaaaagaaaagaagaaaagaaaagaagcagcuuuauguaguguuugaggagcagagcacaggcugcucaggaggggcgacccugacggagccaucuguuugcucuuuacuugacggaggccagccucgagggaggcugaggugagggaggcugcugaugucugggugucuugcuucccagggccuggggacugacgaggacucccucauugagaucaucugcucacgaaccaaccaggagcugcaagagaucaacagaguguacaaggaaagugaguagccugcuucugagacccacccucuuagcccagagcguuugugcauccccgugcgcacucuugcaugcgugcucccgugcaugcuugcguucaugaguaugaagagaagggucaaccucaggugguguucucgggagccauccaccugcauuuugacaauguucucgcuaagccuggagcauaccaauuagucgaggcuggcuggcuagugaguccugggaugcccuugcuucugccuccacagcacugggguuucaagcacacacuuagcacauuaggcacagucguggaggucagaggacaacccucaaggcugcggauucuauccuucuacugugaggggguccggugccuggaacucaggucaucagaugcggcuguaagcacuuuuaucuacugagccaucuuagcagcuugagaaacaauauuuuagucagagacaaguucgcugauuaaagagaacccggggaccccuggguuugacuuaggcuuguuugucccuuagacugacagucacccuagauuugaucuccugugaguagacccccuucuagaaacuccauccucaguuggggacucaggcuauuucuacacuaaacaacaaugccugcguuuugaaacuuggugggugacagacccguuguagugggugcuugggugcuugggugugccugcggggggcaucaagccagauguguugucuccucaguguacaagacugaucuggagaaggacaucaucucugacacaucuggagacuuccgaaagcugauggucgcccuugcaaagguuggucucccucccucccucccuccccuugccuccuuccacagcaggcucagcuccuucuauacuggggagggaauuaacuaaauccuugugccugcucagaaauuccgcugcacucccgucucugcagaacugucauauuuguuaauaggauuucuuauccugcagaacccuguggacaacuggacgcggggccaggggaggggugggcagcucccaagcucuggccuggauuucugugcuaaccugcaccgagugacuaaaggaaggucacuuugccucuauuuguggccacagcggacgcauuaaagugaccucacuccuuucaccuuucgcuugugugcgcgcacaugcaaaccuugccucacuaguccuuuggcauaugugugggucuuugaggcacuuugcuaacauuaccacauuaauguggauguaaggaaugucucccgugaaucucuaguuccggccggcaugcaccuaaacaccagucucucaagggaagggaauucucucagggagcccuguggcaagugacugaggaguguguugcagccuggcccacuugcaucuccaugacagugacaacucugugacucuccugucuucauuugcuccccauccaggcacugcagacucugggucuuuuuuagaaucuacuuguaucuugcuucuuugaccaaaacccauagcuucuauacccuuucagaaagcuccaccaccuucacccugggccugggaacccccaucuucaucacuguguuucuuuccuucuucucugugaugaccuuggguguuguaccacucaccuguagaccuguuccccuucugccugugaaugcagagugccccuggccaccaccaaacugccagucccugaggguucagcucaggccccguccuagcacuucugggcucagccuacuguuuacuacaauagcucuucccuucauuugcauacugcaucaucacggcacucucaguugccaugagucucaccauuauacacagcuugacggaugagacuuaaaugggcucagcuucucugggacaugggucagggaauucaguaagaugcucacucaggcuagcguacccaggguuggcuaacaauggugagacagagcuuacccacuuccuucccugaccaucucuuucuucguuggccuugucuagauuaacaugugaaaugcuguauucauuugggaaugagguuauggcucacccgggguggagaggaaacugaugguccuuguuuuuuuguuuuuuguuuucccugccuccaguuuuagaaugcaccaagagcuaggucugaugguccuucuuguuuuuccccuacagggcagacgagcagaggauggcucaguuauugacuacgagcugauugaccaggaugcccggguaugugccaagcuucauggcguguguauuuggagggguuguaucucacacaacuauuucuuuauguacaaugaauaaccucaaacuaacauuuguuaucucucagauccucugggucagggauggagacuggguugaucagauaauucuggcucaaggucucucauaugguuguagacaagacaaguugguuaggacuguaauuacugagagcauggccaggucaaaggguucuuucccacguggcucaugugugacuuacuguuggcaagagauguuagcacuccuccacguaggccuccacgggcugcuugaaugucccugaugacauugccgcugcccucccuagagcgagugauccaagagggauccagaagcccucaugcucuuaugacuccgucucaggugucacacauucuugucauauucugaucauuagaaguguguccaugaauccagcccacagccgugggagggguaaaacuaagugaugucccuucuaagggaggaaugggccuuuuaaagccucagcccaucugagaauaugagguuuguuuccaggaaccguaguuguaaugccagggucaguuaccagcucuguacccacuucccguuggcucauucaggcucugauuccacagacgugcuagguccugacacuaagcugguagggaagccggagcagaugagguaggcacaccaggcuaggaaggcucccugcuccacucaguggggacaggggcccguggcuuccucauaaagcuaauuuagacagcugcaaacuagguaugccucacccagaggggucagcuguuugguuaucuuuuagcaagcaagucauaauagcugcagacaaaaucaugcaccuccacuuuaauauagucuggggaguacucaaguauaagagaaagguuuuuaacacgugcuacaaguaggcuuuguggucuagggagauagcucagcguggccccagaagccagaacuugagcacaccuguucuaaguggcgcauuguggguuacgccugcaguaugagcucgugugcucacuugucucuuggaaugggcuuuuuaaguaacauuugcuaggggugggugugguuaacuucugguuggcugcaucucugcuaggggugugugguuaacuucuccugguuggcugcaucucugcuaggggugugugguuaacuucugguuggcugcaucucccacaggagcucuaugaugccggggugaagaggaaaggaaccgacguccccaaguggaucagcaucaugacugagcgcagugugugccaccuccagaaaggugggugccgugccagcgaggccucggggccuggaggcucucagguggcgaaggcugcaccgaggagcagauagaucuccagaacaacaccuguucuccacgcagaucuuucaguuuccuuuaucaaaucacuuggccuccuaucucacugugaacccucuguccccaaauauguucaauauuugauauguuaguuguuucacuguguguguguauguguguguguucacauggauguauuuguauuugauugugcauaugggagccagagguaaaccuuaggugucacaccuuuggaaccguucacccuggggugguuuuuguuugucugguuugucuuuuagacucauugcccuugaauuaaaaaaguaggcuaggcaaccuggacagaagagagcugcuauccacccgccucagccuucacagcgcugggauugcaagcacaccaagcacaccaucguguuucgcuuuuuuguuuuguuuugauuuugauuuucaaaucauggguuuuggguuugggggcuaaacacagggccuucugguugguuguaagacaagcauguugccaaccgagccgucucccugggcuuccccuguuccccuucuuacuagaggauccuuuguucuugccacgauuguugaaguacaggacauaaccacccggcucuuacuguuucacaugacauccacauagauggauuccagugagagagcauagagauggucacauucuguggccuaggcagagccauuagggacaggagcuagaccuggguccucuggcaagacagguacaaaucagcucugguccaccaaggugaccuccagccccuagaugaccgccuaccccuaggaugcaucaggaaucaccuuuaguuguugguuguuuuauuuuuguugcugcuguuguuuaaucaaagugucuaauuacauagaucaugcaugcagcuuugacuagcacuucugauaucauuuguugcuuuucuuaguguucgaaagguacaagagcuacagcccuuaugacaugcuggagagcaucaagaaagaggucaaaggggaccuggagaacgccuuccugaaccugggugagcaaguauggcccuuccucccuggcagggaggacagaaacaggaggaaggaauggcugugugcuugcuucaaggggacuugagaggugugguggcuuuucugcaugucuuggagaguuuuaggauugacuguagauuuaaagauaugaaaugggcuuaaauugccaggaagggcuaaguuggguggagaagggagggcuauacugggcaagcuuacauagacacccggucgucagugaccucugcaccucgugguugaagguaccgcaguggguagagccugcuaguucacaagauucugaguuccccuuagccuucuacagccuuuguccauggacgggcccauucuggucagugucuuagggccaggcgggcagcccugaccucugucuccuucccacaguccagugcauccagaacaagccccuguacuucgcugaccggcuguacgacuccaugaagguaaggacugcuggcccagaggcuccauuuccacuaagcuccaccucuguuuuggcucaaacugaaucucugugacuaguguuuagggcagugguucucagucuuccaguugcagcaacccuuuaauacaguuccucauguugugguggccccuaaccauagguuauuugguugcuacuucagaacuggacuuuugcuauaguuaugaauugcaauguaaauaucugaaacgcaggauaccugguaugcaaccccuaagggguugagacccacagguugguaagcacuaguuuagaggauggguucccacuagcuagcugagauuguauuuggcaggugagaaagcaccauuccaucuucucucaguuguuuaaauacaugcgaugcagcuccagaauaaggugucacuggagggaaaggguaaggugacaacggugucugauuucugcuggggcuuucagcuauggugucccauuagucccaggauaaaagcaaacaggaugugagugaccaucagcaggcacuacacaacagcuuuucaguucccucccuuaaguccuggcaggaaacccugcagggcguccauuuuuaucuucuugauaaagaaggcaggcagagcgccuggagccaaggccagcuuugcagaugcacagcugggugaucuuccugcaugagcugccccggacgagccuuguucugguucucguccugccaggacuggucugcuuuccaggacccugauuucuucucuggagcacccccccuccgccccccguguccaugcugacccucugccugcucuccuugggcucccuguuacagauaguuuccuuagugcaggcuauuucaugcauucacaaagagccauaagaacagcgugccgacccauccucucugcaccccuaaguguccaccagcccuuugcugcauaugcaaacuugcaggcuggcggucagaagcagagcugacuggagaggcggcucagcaguuaagagcacacacugcuccugcagaggcccccuuggcuucucagcaucuaguuugaaucauucauaggcuccugaaacuucagcuacaggagaucugaugcccucuucuggccuccgugugcaccuacauguacaccuaugggcucccccagacacauacuuagaaauuuuuaaauaaaucuugaaacauucagaugugcuuggaaaucuaaggugcucaucuucauuaaggaaacagucucagcacugcauuuuuaagucuuguaagaucacgacccacaugagugcaggcauuaaacaagcuggcugcuguugucgaaauccugguuuggcucccaguuccaggcuggacagcaagcaaccaucuggaaugccagcuuuaggggaucugacacucuuuucuggacuccagagggcuucccuagacacacacacacacacacacacacacacacacacacacacgagccagaaaaaacuguggugggugcuuuuuuuaaugauaaccuugucaaggaacuuaacucugaucaucacuuugacuuucagggcaaggggacucgagacaagguccugauuagaaucauggucucucgcagugaaguggacaugcugaaaaucagaucugaauucaagaggaaauauggcaagucccuguacuacuacauccagguaaagccuguggcauggaccuggcucugccaggcaugguguguguguguauaacuauguggguguguauauguguguguacaugugugugugcaugcaugugcaucugcauugcaugugugcaugcauguguguaugacuauguggguguguauauguguaugugcaugugugugugugugugugugugugugugugcaugugugugugugugugugugcagguggcuguagagaacaauggcagaguggugaccuuccuguuuucucauuucguagagaauagacucugggcaccaagaaucagggauuuauauugaaaguagccuauaugauuuucguaggcucauagguucaaagcagguuuauacauuucccacaagugucacucuacaguggucauagguguuuauagugacgauccugcaugaccuggugacaaucagagggacucugaaggccaaaggcguuuuguauucuauaaugcuccugcuuccugaagauccucagagaggccugacaauuugucucuugccaacccaccucuucugugaacuuagugucugcauuuuggaaugcuggagccuuccugguguuaacacugugcucagcugccaggaguguuacucuggggauggagccuaggccuugcauaugcuaaguaagcccucuaccacugagcuagcaaccacagcuuuuuaaacuuuuuuggguggugguaguauguguauugucugggugugggugugcaugugugugugcaggccagcggucaaccucuggagucauuccucaggaacuguccaccuuguuugcugagacaggauuucugacugagagucgggacucagugacugaaugaggcuggcuggguggugaaccccagagauccuccugucucugcuucucagugcgggugacauugcacaucaccagcccuggcuucuuaaaguggggaauugaacucagguccccaugcuuguguggaaagcguuuugcagauuaaacuuucucccaaccccuccuucuucucuuugagaaggguucucacuaagaugucugagcuggccuugaacuugugauucuccugccucauccuccuaguuagcuaagcuuauaggugugcauuaccaggcuuggcugcaauccccuuucuaaaagauccugacauuucuauaucuaucuuggucuauggucaccaaggacaauuguguguguguguguguguguguguguguguguguguguguuuuggggggucagugcagccaugcuucuuagggcacacgauuaaagccagggacagcuaagcuguuagaaauuauuucuccacgucacuaguuauuuucaugcauccuuaaaguccacaaaacuucaaagggaggcagccaagguucuacccuguccugugcagaagggcgcaggugcaggagaaacucgggccugcugcagaaggcccugcaggaccugcagugugggagacauucuccgcccucccucgcaguccugacagggugacguaccauuucccacugcgcuucagagggccagggcuuugguccacugugcaggccugcaaguccccagggcacaccaaggcuauggcggguugcuguacaaucuauuuuuuuuuucuucugacacuacuuuucuuucuuucuggccacugcagcaagacaccaagggugacuaccagaaggcacugcuguaccugugugguggggaugacugaagggcucagcacaguggaucacccagaaguggcucuaccugugccccaaccuggcguucuagagacuucgcucuccacuaauggaccccugagcuccucccugugaggaugaugacagggcugccgacccuuuccccaucuuagcugcccuugccuggcuuucuccucauucucuccuuuaugccaaagaagugaacauuccagggaguggggcguagcgucugugacaugagacacuuccucuuauguacugugucgugaauaaaccguuuuuacuuua

SEQ ID NO: 12161 - RNA, 87503 nt, Mus musculus
ccacgcuugcuccaacccagccccccaagccucgcgcgcagccgcagagcgggucccgccccuucucgccgcgcgccccugcaccccagcgcgcucccggagugggccuccuccgccgcagcgacgccuccuccuccucuuccucucuccuucucucucggucucucgcucucucucgccgcugcagccuaguaggggcgcuucguccagcaugagcucggacauggcagccgacgagucggaggccccaguacucucggaggacgaggugcgggaaggcugcgugccgcgcggggguucaucguggcgagggguggccgggguggguagcggggguggcgggcgaucggggcccgaauuuggccccgcgcuccggagcggggcaggcggugagggggagauggagagaggcgcgcacgaggccucugcgggagcagauuccccgcuugcucgccucgcugcucggggccuugggccucccccggggggccuccgggggccuuuggcugcggccugggcgcgcucgcucacccucuccgggagggccauggcuuggguggggcggccucccgagacucagcaucccgcuccugccgcagcgggagccgacagaacuuagcgacuuugccacuauggcuucccgagggccaggguugggaacgaagggggguggggggagggugggauuccuucgaguccgcggccagcgucggauguggaaaguucacacuuuguuuccaggccuuuguuaguauuuuuuuuuaagugaaggcaaaagaaauagagaaauacuuuaaaagaacacccagcagcuguuggcuucaaaaacugcagcccaaggauucguggcacgcaaaaccgucuguuacagaggaacaacuuaaucgcgacuuugccucgcgcucgcugaaagugaggcccucuugagggagggcuucgauggagcuggcggucgucucaaauggguggggcauuagagacuucgaaguguuuaacagugacccuuucagauugugugugugcgcgccugcgcgugcgcgccugccugugugugugccugugugugccugugugaauccaaucuccggguuucuguuacuuaaucuaguggucacaugugcauuuuaucaagauugggcucaauuagcuagaaauuccuaacccccccaauuuuuuauuccuuucucagguaccuccaaacacuauuguaauggcgcccuccaauuuuuccccguuucccuaagagcuuuuuguuuaucuauagugggcgcuucauuaagauaauuauugcaacauauuuugaaaacguuuguguguucacacccgugcgugugugccugugugugcguguauguauugugguuggaauuuaauuuuuuaggcaauccuguuuuuuuuuuuuuuuuuuuuuuuuuuaaacauugguggacuggaggacauauuaaaugaacuaagcccggccuagagagagguuacuugagaucucauggggaaucuagaaaguugcuauuauaaaaguuguuaguaaagggucugaagagguggcucgguggccgagcucuuguaaaggaccaguguacagccccaugguggggccccucauaacaguaauuccagcucuggaucucuguggcaccagcacacauggcauacauucacucucucucucucucucucucucacucacacacacacacacacacacacacacacacacacgaguacauuacuggagcuggggagagcaguuggggaagagaggccaaagcaaaggccagugagaguacugagucacaguagcuguaagcucugcugggcuguuaaaugcacggugggcugaaugcuuauauacuuuggaaugcuacaagaugggcuguagagaggacuuaguuaagagcauuuggucuuucagagaacuuagguuugguucccagcacucacauggugguuuacaguccucagaaaugaugcccucuucugaccucuguggaagucagcuauagacauggugcacauaagcacaugcagcaagacacacacuaaauaaacaaacaaaccaaccaaccuuuagaaaaaagcccaguucucagguaacauuuagaauaugguaacaggcagauacagaagguucuagguacucagaagcagcccucccccuccucuagccaggggugacggucugcgcagugcccacuauuucauaggagucaggaguuacuguugcccuguggcuaggaugccuuuccucuacccugccugcugcauacccacucaauuuggaagaucucaaguugguauccuacucuggccuugggcuucuggcuggcucguccagcuaccucuuccagcagagcuagcuggucacagacuaaauaauguuaaaguuaucuuucucugucucuuuucucccucuuggcccaguaucuguuuuccagauuguccuuuucaucugcccagcugaaauaaagaaagaucuguguggccgcuagugggugcgcagcagcagcuggggcucggagcucccucuguaguaaggacuaacugaacuuagugaaggaucuauacuucugaagagcuuaugauccggggccuguuacauucccaugauaaagguuuagauguggguucugggacucaaauuuuucuccccucuuucugugucuacuuugugcucacuaagggagagaggcaggaagacagauaggguugugagcgucuuccacugcggggcuaauuggguuauuaauauucacucagcagacguucauuaauguucugugugccgugugccaagcaccagggauacagaggauaaaagaccagccuccaaggagcucacugucuggugaacaagcuagaaauggcucguuugcugguugcagcuggaagcucauuccucucauugggcauuuauuuauuuauuuauuuucugguuuaucacagaaccaaauggcagcuuggaacacagcccaccccacacacacccaaauaccacaugcccccccccccacaccacgaacacuacuacacacguacacaucacacacacauacauacauaccacaacaccccccacccccauacacauuuuguucuuuauuuaaagauggaaacauggcggcugugucaucucuugagcucagacuagucagaguaggcagccugcugcuguugauuaaaaguguuuggacuggggugugguuuaguugguugagugcuugccuagugugucugaagccaugguugaauauccugcauugcguacaacggauguguuagcccaugcuuuuaauaccagcaccugggagacaggcaagaggaauucugugaguucgaggucaguaucaucuacauagcaagguccugaacagcuaggguuacauaaugagaccucucagaggggggaaaaaaaaaggucaaaggucauguagcaguacgucagagcacacaucugucauggcaaguggaaacggagggccagaggcaugagcgccugacuaagaccaaccagagcugugcugugagcgccugucuccaaaagaaggaaauggauucaaacaaaucugaaacaaggagaaagaugaauagaaauggcacagaauguagagaauuguggcuuaaucuuacagagcgauuaggacucacugggugaugugacggaggguauuaaagcaugcugaaauuggaucuaauaccugcccccuuuuggaugaguuuuaguuuuuuggguuuuuuuuuuuuuugguuuuuuugagacaggguuucucuguguagcccuggcugucuuugaacucacucuguagaccaggcuggccucgaacucagaaauccgccugccucugucucccgaguccugggauuaaaggcgugugccaccacgcccggcuugaguuuuaguucuuuuauguauagccuauggaaagagauucuguuugcagaaauuuuacuauuaggacauuagcuaaaugaagaaguguaauauaauuuacaugguuugcucugguggccacuuaggauuaacuacagaaaauaacucauuccuuuugcuuuuuuugaaacagggucucgcuguauaaccuggagaacucuguagaucaggcuggccgggaacucagagagcugccugccugcuugcugugagauuagaggugcuaggcauuguccccagagaaagaugaaagaaaggaugagaggaaggaugugggccuggggguuauuaccuguuguccucccagggcacugccgacucuuuuuuuuuuuuuuuuuuuuuuuuuaaagauuuauuuauuuauuuauuauauguaaguacacuguagcugucuucagacgcaccagaagagggcaucagaucucauuacgggugguugugagccaccaugugguugcugggauuugaacucuggaccuccggaagagcagucgggugcucuuacccacugagccaucuuaucagccaggcacugcccacucuuuagaggcugggaggcuggagacuuuucccaguuagaguugugagaaguagguuuccuauuaagaugcacucacugaagauggggggggauaaaaaagagggguaucgcuuuggcuuuuucugcugauaagcauacauguaugcagguugaauuuuucuacaauuuuuucuacaguuuugaugacugcagagaagccucaguaguuaggagcgcuuacuguuuguguagaagaccugaguucaguuucuagcacucacuaggcagcacacacacaagccuguuacuugaacuuggaggauccccucacucugcuggccuccacagagccccacacacagaugcacacgcacacacacacacacacacagagacacaagcaucuaauuaaaaauaaugaagggaaaccaugacaaaaaagagugccaaugucugaggcuggauuuguagcuuaguuggugaagugcuugucuagcaagagcacuggguuuaugggugugguggugcauaccggaaucccguaucuggaaauggaggggugggguuaagguucaagaugcuccuggcuacauguaugaaugcagagcauccuguaugugggcauauacucuacuaacuuagcuaugucccuagcccugaaucuuuccuacuuaaauucauagaaauauuaaggaauucuucugaaaaucuuucugagauuuaacaaauuacauuuauuuacuuguuugugcgcacgcauguguauguauucgugugccauggugcaugaauggaaguuagaagcagcuuuuaggaauccucugucuaucaugugggucucaggaauugaacuugagucaccagacuugucagcaagugcggguggggagguguggggggaagggacauggagccauuuugcugacacacucuugugaacauuuauuauuuauuuauuuaagacagguuuuuccucuguguagcccuggcuauccuggaacucacuuuguagaccaggcuggccucaaacucaaaaaucugccuaccucuguauccuaagugcugggauuaaaggcgugcgccaccaccgcccggcuucuugugaacuuuuuuuaauuuuauuuuuucaagacagaguuucucucugaacuacugucacccagugaauuuuguuucuuucuuucuuuuuuuuuaagauuuauuuauuauauguaaguacacuguagcugucuucagacacuccagaagagggagucagaucucguuacggaugguugugagccaccaugugguugcugggauuugaacuccggaccuuuggaagggcagucgggugcucuuacccgcugagccaucucuccagcccgaauuuuguuucuuaugcuuguuguguaagauaguaauugggugccauuguuaauguugucuuuuuacauuucaauauggacucuagucauuuaauaagaccacaaaaauauaaggaguuggagguuggaauuauauuggauuuauauauuacuuuggagaaaauaggcaacuuauuaaaauuuuucaucaacaagcacagagaaugucuucauuuauuaguucucuaauguccuucaacaguguuuuuaauauuaucaguugaaguuuguuuauuuuguuucuguaucuuguacaauuuuaaacauauguauguggaaaaauauguauauugagacaggauccuacuguguagcaccggcuaccuuggaacucauuauauaguccagagaucuaucugcuggcuucuaacuccugagugcuggcauuaaaacuauguacaaauaguaggggaaggcucuuaaugaggaauuaucugaaucagguuggucugugaacagauguguggggguugucuuuuuuuuuuuuuuuuuagauuuauuuauuuuauuaauguaaguacacuguagcugucuucagacacuccagaagagggagucagaucuuguuacagaugguugugagccaccaugugguugcugggauuugaacuccugaccuucggaagagcagucggguacucuuacccacugagccaucucaccagcccguggggguugucuugaugguuacuucauauaagaagacccaguuuauugugaguggcacucagcucaaguaacuuauucucaccugucuuagugucuuauugucugagagacacuaugaccaacagugagguggggaggaagggcuuuacuuagcuuacauuggccacauugugguccaucauugaaggauuuagagcaggaacucuagguuuugcagguaccuggaggcagaagcuacuguagagcccacuuacuggcucgucauucauugcuugcucagccugccuuaaagcacccaagucuaccagcauagagguugccuggcccucucacaucaaucacuaauuacaaauacuaguuuacaguccagucuugggacauuuucugccuauauugagguuccuucucucaugacaauagcugugucaaguucacauauaacuagccagcacaguuagcaugagucuauaaaaagagaaugaacacaguauuaccaggcugugcacugaguuuacggaagcuugcauuauacugaacugucuuacagacauuuuaggcagggguuccaaacaauguaagaggaaagcugacugaugggcagcaagccucugcucgugacugaguauauaugagagcugcuucaauucuugccuugauuucccuguauagccccagcuguccuggaacucaaauccaccugccucugccucccaagugcugggauuaagugcgccgccuggcggacugaauguuuuuaagccaaauccccaagguugcuuuuuauuggaauauuuuccccaguaucugaaaugaauccagaauaccuacccuuuuuugauuuaaacgauuuauaaucuguagguuaagagugcguacaacaguguaguccacagcuuggagacauuaccuacauuugcacagacucacauccaacuuuuuauuugcugagccacuugagaauaaguuacagaauuugugccauuuucugcugaauacuuuguuauucaucacuuuagaaaguauaauauuuuuauuauuuuguugagaauuucacaacaauguauuuauuuuuuuaaauuauggguaugggaguuuugccuggauaagacagaagaugguggcggaucccccggaagugauguuacagauacuugugagccuccauguggaugcugggaguugaauccgaauucccuggaagaggagcacgugcuguucacugcugauccguaccuggagcuccacaacguauguuuuuaaauucuuauuuaugcguauggguguuuuguuuguauguaugccuuuauaugguguguauuccuaguguccauagagacuggaagagggccucuucagaccuuagaccuggacuuagagaugguugugagcccccguguaggugcuaggaauugaauccagauccuuuggaagaacagcuaaugcuuuaaacugcugagcuauuucucaaccccccaaauuaaugaauuuccuuugaggcaggaucucauaauagcccugacuagccuggaacuugcuauguaaaccacgcuggucuugaauuguucuagugcuggcuccaagggguuaaaguggcuuaucaccacaccuagccauagacaauguaaugugaucauauuuacccugccaacuucuccccccagcuacccucagaugauauaucucuuuuaagacaaggaaauucucccaugagaccucauuccacuguugacaugcaagaucauugguauuugacauaucauaguguguucacuguuauuuauaaacuguuuaaugguacuuaaaaacuaccuuuucuuuguaguuauuacaaaugacuaugagcuuuugauuucaugguaugaacacagcaacagugguaacuuccuuaguuauaauuugucauuaaaaguuuauuauaagaaagcuaaauuagggggcuggugagauggcucaguggguaagagcacccgacugcucuuccgaagguccagaguucaaaucccagcaaccacaugguggcucacaaccaucuguaacaagaucugacucccucuucuggugugucugaagauagcuacaguguacuuacuauaauaauaaauaaaaucuuaaaaaaaaaaaaaaaaaaaaaaaaagaaagaaagcuaaauuacuauguguaauaacuugacuuuaguucuuugguuuuugugugugugauuaaauguaucuaaaaauuguaaauuuugucuuuauuuucuucuauauagcuuucaaucagauuacuuacuuuuaaauauuccuuugaauuuaguauucucgugacuauuguauuagauagcuuguaaugacaugaaaauaaaacaccuuuuuguauuuuaggaugacacacgaguugugagagugaagguuauagcuggcauaggccuggccaagaaagacaucuugggagccagguaaauaacaaugcaugagcuugggguuuaaggaaacaguauugcuuaguuucuuucuugaacuuugauuaaaugaaaaucugagugauaguagcaaauuuugguacacagugagauccuuacaggguaaguggcugauuauuuucuugguaucugaaucaaugaauuugcaaaauuaaagacaguuguaguuauagauuuacuauugaguucugcccccagaauuugauagcauuuuaauucucuaaauccguuagcagauaauaaccagcauaaucucugguuacaguagaaaaaggagcucugaguaucaagugagcagagcggggcgcacuggguuggagcuacaugggagagacccagugguguggcgggguucccuuagaggaauuagucagccagggagaauuacaaccugaggcagggguugguggucuccacagccugaaaaccuggagcagggguuggacucugguggagaaaugagagauuggcaggaagccuggcagugguggggauucuggaagagaaagaguuggccucucagcuggugucagaagaucugagcagagagugagugucuaaacaagauagauaaacacagaaaaaaacaacccagagucucuguaacucagcuuacaauguccacgguacagcauguagucaccuggucuguaaagagcaagggaagugggacacacugucaaucaauaaggaauaugugagcagaaugugaugggaggcacucacggcuagucuggucuacauagugaguuccagggcugcauagcgagacucugucuccacgaaacaaaaacugggugggaaagaaagaaaaaaagaaagggagaaagaauauaugcucauugucagucaaaacauuggaaaucucaggaaugaaguagagacauaaauagauaaauaaauaauaaaauaccggggaaacucuacaacuaaaauauaauugaaauucaaguucuuugguuggccgugauuucugaauggauacauagaacaaagaugaacugaacauagauuaauggggaucauuuaccaauuagaagaugaugaagaagaaaggucuguuugaacuacaucccagagagauaaauaaugaaauaaaaucuuuuuaaagaauaagugucuaaauuuggaaaacgaucaaugaaauauacaacuggacuggagaguuggcucagcaauccuguauugcuuuuacugagguuucccugggaacugccugugaccaacuccaggggaucuggcgcccucuccuggccuccacaggcacugcacacauguacacacaacuuaaaucuuuuuaaagaagaaauguuaaagcagguuaaagcuccuggugaagagaaaggaaaagaccaucagaagugauaaauaccuggaaucuacagaugcuuuuuuuuuuaauuaauuaaaaguuuuauuuuuguguguggguguuuugucuucauguauauguuugaacauuugauguccauagaggucagaagaggauauuagucuccuggaacuagaguuauaauuggcugugaucugccauguuugugcugggaaucaaacuugggucccuugcaagagcaguaaaugcucuuaaccuuauacagggcccauuggaaucaugauucaacaaccuugucuuacggauucauauuagauaaaagggaugaaaggaaugcuuaugggaauaacagcauaaaggauaggguguguguuugcugugacccugcauggaaggaucgugugguagaaagcauaggcaaagugaaucauuaaggguaugaaauagaaaacauaaucauaucaacauuucaacaguaaugugaagaauuuuagguuuuguaagagcagaaauuuggagguuuuuuguuuuuguuuguuucuuuuugacaguuucucuggcuauccuaaaauuacuucuguagacuaggcuggccuugaacucaggacugccugucucugucucucaagugcuggauuuaagggcaugugccaccaccaccauagcuaugcaagcauaguuguacucuagagcuguaaaagcagaaauuuuaaacugaaguucuugaaacaauuaaaaagucaguacaaaacaauucuuuuuaaaggggacaggacaagggaaggaaaacaugaguuaauauacuuguauccaaucauguaauaauuacaagcacccacauuagcuggcuuacaacugucuguaaauccagcucacggagauccaacacucuuauggcuuuggcaggcacauguacacauaacacagaggcauacacuguaugcacauaaauuaugaagcaacucuuuaaaaaacauacuuaaauucaaugauauaccuagguuggggaaaauggaugcaaaaaugguaugauaaagauuaacgugaauacgagccaggcaguguggcacaugucuuuaaucccagcuaucaggaggcagaggcagguagaucucugacucuguaggccagccuggucuacauauagcauucuaggaugguuagggcuacacaagaguaacccugucaugaaaaaaacaaaaucaaaaacaauuaaaaucugcuaaaauaagggaaagguauuuucaaauauuucacaaugauaauaaaaucaccaggaauguauuaggcagaaauggguaugugccugguaccagaacuugcagauguauggcucaaaacuugacagaauuaaaggaaaaauuaaaaauucuauuuuggauaaagacaccaaugccuuuuucaaaauuguuaaaacauaauuuuugaaaaaaucagaugaggcuggagagaaagcucugucauugagaguucuugcugccuuugcagagccccauguugauuuccaacuuccaugucugguaucugguagcuaacagcugccucugacuccugcaggcaccagcauucauaugcauagcgccccccaacauaauuaaaaauaaaaauaaaucuuuaaauaaaugauaaaaauuguacaguauuaccaaugacuuuggcuuaagaacacauccuaaaggcugcagagcaaacauucuuaacugcagaauagauguucaaauguauacaguacauugacagucaugggccugugaggauuauuaccuuuagcugucugguaauauuaacaauagcuucgugucucaacaagcauguguucauuguucacagucugaaugauucagaagccccugagccuucaccuugauccacuguuaauggucucacgaaggaacucuuguguaucuguuucuaauuugguuaugaggucucaagagggguugucuguaaacucuagaccuguccucaugaugcuccagagaugucacugaguuuucagaaugcuuuugugggucuucacccugugauagaaccuccagucaccagaugugccucaggagauuugcauaucuuggccaaugcccugugaccucuggucugaucuggguccagguucuucauucccacaaaggagcccauuuccaggagagaagaugcauucaggaugucauucaggugaacacagggaucaccucaacaaaaucagagauguccauagcugaauagagaacaauggccucaccaggcaaggggcagcuggggagccccagagugugcuagcacaugugggugagagcauuuggguauugcccaugugaauuucuucuuuuuaaagauuuuuuuuuauguauaugaauacaacauugcucucuacagacacaucagaagaggguauuggaugccauuacagugguugugagcccccaugugguugccgggauuugaacucaggaccucuggaagagcagucaguccucuuaacccacugagccaucucuccagccccugccucugccuccuaagugcugagguuaaaugcaugugcuacuguauccagcaauucuuaguuuuuauuuggaggggcuguagcucaguuugccuaggacauacuagguucagucuguggaccaugaagacugguugugaugcaugucuguaaucuaagcgugaggggagaggcaagaaaaucagaaggucagcauccugcucagcuacagagaguuuagggccagcgugggcuacugaugaccugucagggagagauggagagaaagaauacaaauugagaacgguguaggaacccagacauaaguauuucaaaccuuuuucagaguagaucugagaacagacagaaagcagaugggauuugaagagcuguugugggggcgaaguauggcuaggggguugcuguguugugugcuccuuccuguggaggagugcuguagucucagccacacucucucacugcuguguagucuguacaacuuggagaaaacgacaguagcuaacccugauccacaaaaacuguuuggagcaguguuugauguggaguaauuucuauguaaguuauuaccaacuuucucuuguaacuuuaacugagaagggaagaaaaagacauuugcugcuuuccuagaaggaguuaacaggaauaaggaauagaggaguuucaaaauguauugcuagaucaugaaaagcuaggacaaaggagguguugaaaugggcugacugccuuccaagguggaucaugcuaggcaagagugcccugugucuccaaacuguccuugucccuauuucccuggggcugcagagaugagacgagaucuugcuacgcuugcagagaaccugaguucuguuccuaguaccuauuuauguuagauggcuguguaacucuagcuccaggggaccugauaccuucugauugacauacaugggcaucuguacacacacacacacacacccacacacacacacacacacacacacacacacgagucauaaacaugaauaaaguaaacuaagccuuaaaaaaauggaagagcuucuacaacauguuuuuuguuuguucugagacagggauuuaaccauguagcccuugcuggacucagauuuccucugccuucggauugcuuggaucaaaacaugcgucccgcugugcuuggcaagauacaauuuuuugguuuuuuugagacaggguuucucuguauagcccaggcuguccuggaacucacuuuguagaccaggcaggccucgaacucagaaaucugccugccucugccuccuaagugcugggauuaaagguuuuuuuguuuuuguuuuuuucaaaucucuuuauugguucuuugugaguuucauaucaaguaccugaguacugcucauguccauuccuuaugucuguauguccgucccuucccccuuucagccuccgccucguccccaaucaaaaaaccacgaaagcaaaugacaaaaagcauggaaaacaucucaucgugaaagcuguggugugucacacugucccacacauuuccacuuguaaugagucauuugacuguucaggaucucuagcuucugugacaccaucaauauuagaucuucaucagcacucuucccaguuaucccguuguagcccugugucauggagauccugcagcuggaucugcagaacuagccuugucuugugucucagcuugucucagauggggugggccaauuucagaaccucuggaccugggccugugugguagcagagcuagccaacccaccagcuucuucuuuaccuggaccaucaguacaaacucuccaggcuugcucuggcauggccacccaaugcugccguuggcaggaggcagggcuagcucuccugcacucauacccuuagcuggcucaccuguaucuaggccuccagagccaguucugugcugcccagucaaggcauggggcccacucucccaaguucuacacuaaaucuuuggucauucuacagaugugguaauuaaaguuuuuaauaaaguauaaauuucuauaacuguauacagaucccugguuuuuaggguacaaagcaauagaaauaauagaacugaaaaucugauaauuugaacaguuggacuaaauuacuauuaguaacuacuaaaacuuacuuguuuuuaacuuuuaacagugauccuuacguaagagugacauuguaugacccgaugaguggaauccuuaccagcgugcagacaaaaacuaucaaaaagguuagauuuagccagcuuucaaagauuuuuaauaaacuuugcuuuuucuaugacaagucauucuaaaaaauaaauuaugcuacguuuauugucuuuuagucuuugaauccaaaauggaaugaagaaauacuguucaggguaaguauuauuuuauuaaaaauuuuuucuuuguagguaccauuauguagucauuuacaauaucuuaaaauaacacuuugaaaugugccuagaggguguuuuuuaugagacaggguuucucuguguagcccuggcugucuuggaacucacucuguagaccaggcuggccucgaacuccgagauccgccugccucugccucccaagugcugggauuaaaggagugcgccaccacugccuggcagaaagcaugguugcugggaauugaacucaggaccucuggaagagcagucagugcucuuagccucugagcuaucucuccagcccuuacacgcccuucuuaacucaccccaccucucauccuguccugcuauucaagcucccaguagagugaggggcacacuucugcccuuccuguucccuggaggguggaggaaaugcauuuccagucucuuggcuggaucauuucugcuuguauuuuccaucuuuuuuauuauuuucauuuacauuucaaaugcuaucccaaaaguccucuuauauuuuccuuaaaaugguuuuuuugugccucgguuucccuuuuuucugugggcuuauacuaagccaguauucuuuuuuuguuuguuuguuuguuuuuguuuuucaagacaggguuucucuguguagcccuggcuguccuggaacucacucuguagaccaggcuggccucgaacucagaaauccgccugccucugucucccgaguccugggauuaaaggcgugugccaccacagcccggccuaagccaguguucuuacaaagauaccuuuucauuucauuucugcuuuuucaauaugcuuuccacagcucugaucuugcuuacaacccaucucacaacccagcugccaggccugucugcucucuuaccuuugaugcaaugugcuucugagucaauauuuauuuuauuuuauuaaaaaaaaaguucuuuacuaaaaagaaugggugcuggagagaugcuucaacggguaagagcacuggcuguucuuccaaaggaccuggguuuaauucccagcacccagaagguagcucucagcuguuuguugucaaccaaacugcugguuccaggagaucugacaccucacacagacauacaugcagacagaacuccgaagugcauaaaauaaaaaucauuuaaaaaguuguuuguaugugaaugcaacugugucuguaggcuucugugaaaucccuugguuuuagucagggaaaaggaugcuacuugucugaguuguacauucaguguugaugguggagaacacagcagggaagaaguugcugagguaagacucgugagucugagguccagugcagcaccagcaggugcuucuggcguucauguucagaggaaggucucuacuuagcauaucagaacuagcucuugaaaccagucugagguuuuagagucuagaagaaacaccucagaguuaguuagucauuccaaggaaagugaaacuaaguuuagguuuacucuuucaguccgaggcuacuguggccgccuugggcaguuucuuugcauguugcuuagaauuuucccuuuuuuuuuuuuuuuuuuuuuuuuuuuuuuuuuggcuuagaauuuucuaagaucuuccaaggugcucaguugcuuauuuaaauuauauuauuacuuaacuuacuguguccugcucagaaaugugugcauuuuucagcagaccaacuuuuuuuuuuuuuuuuuuuggcacaucugcucuuguuuuauuuugauucaggacagcguuucucuuuguagcacuuggaacuugcucuguagaccaggcuggccuuaaacucagagaccugcccgucucuacccccaacgugcuaggugugcagcaucaccaccuggcuauuuauuuguuuuugauuuauuuacuuauuuuuaaaucuauauuauuaacuauuacauguuauauucauuauacuuuauuuacuuuugauaacauuugcuuguuaauaaaaguacuaacaaagauacuauagagaggaaugaacuaaaaacuaaaauuuaccaucucuacuucuuuugagauuauuucuuuguucuugcuuuuuaacuguaagaaaaugugaacauugacuauaaaaauauccucgaugacuucagaguauaagacaaucuguucuuucaauugauuuuuuuuuuagguuaacauauaagauauauuguuccauaaugggcuacucaaacauuugucaucauucuuuguucucaguuaucccuuccacagcccuuugcaguacucacugccccucccaggcuggcucccuuucccuccuaccccccauuuacuuccccacuuccuguucuacuuucuccccaccuccucccccccaccucccacucacagacaggguuucucuguguagcccuggcuuuccuggaacucacuuuguagaccaggcuggccucgaacucagaaauccgccugcccuggcucccaaguguugggauuaaaggcgugugccaccacugccuggcucccuguuuuacuuucuuagugcaggauuucuauuuauugcccucuccauucccugcccuuuuuaggaucuuuuccuuuccugcaggucuaauuuugugaucugaacauguaaauaaauacacacauaacaaguuuugcauagaagacaaaacauauaguauuugucuuucucagugacuuucacuuauacuucuaguugcauucaucuucuugcaaacaccauguuuucaauuuccuuuuuuuaacuuuuuguuaauuuuuaccuaauuauaaaaagaaaaauaggggcuggugagauggcucagugaguaagagcacccgacugcucuuccgaaggucuggaguucaaaucccagcaaccacaugguggcucacaaccauccuaacgagaucugacucccucuucuggagugucugaagacagcuacaguguacuuacauauaaauaaauaaaucuuaaaaaaaaaaaaaaaaaagaaaaauaauauaugaauacauauaaucuauauacauauacuuauuguuaauacuuagacuucucauuaaaaugauuuuuccuuauuugugaaaaaauaugacuuauuaaauggcauugacaccaacuucucuguagaugcccucaauuccagugucaacaauuccuuuucaaaggcagaagacagaaaaauuuagcauuugccaaaccagucaccagagagggaaaaguagcuugugguaaauaagucaauuuucuuuuaaaauuaaaaaaaagccccaaauuauucccauuauuucauuuuuguguguguguaugaaauaaucuguuuuuagagaaacuucuuugaaauaauuugugccuuaacaaugagacccuaccauuaaacauaguauacaugagaaauugaguccuccacugucacuuucuuauauagauauuaaaauauauauuacuuaaaauauauuacugggaagguaguuuuaaguugauuuucaauaguuguaucaaauguaaagcauuaaaauaaauaaguaaauaaaaucaagugggcugguaagauggcucagugguuaagagcacugacuuguauucccgagguccugaguucaaaucccagcaaccacauuguggcuaacaaucauccauaaugagaucugacgcccucuucugguguguuugaagauaacuacagggcuggagagauggcucagcgguuaaacgcacugacuguucuucugaagguccugaguucaaaucccagcaaccacaugguggcucacaaccauccguaacgagaucuagcgcccucuucuggagugucugaagacagcuacaguauacuuaaauauaauaaguaaauaaauuaaaaaaauuaagaaaccuuaacuaagacaggccuuaauauuuaaaaaaaaaagaagacaacuacaguauacuuacauauaauaauauaaaaaaaacuuaaaaaaauaaaguaaccaagacucuauaaagcuacugcuuagccuggcgugguggcgcacgccuuuaaucccagcacuugggaggcagaggcagguggauuucugaguucgaggccagccuggucugcaaagugauuuccaggacagccagggcuacacagagaaacccugucucgaaaaaccaaaaaaaaaaaaaaaagcuaaugcuuaaacuuuaggaaaugucugccuacugcuuuguuuacuagguauauagguauugaaacagaggaaaaggucccuggccgucauguuuugcaaacagucuuuugacuguucuauaaauagagcugcagaguacucauggccaaguccagcacuuagcgcacacuguuguaaagcaacaagaagcuuuuuccuugucacgucugggaggaaacaguucugacacugcuccuugacagugaacucuaagauaagucgcagaacagugacuggaagaaagccugcucacuauaaaccauuuacccccagagcuccgggagacuuugugcaguggaggagcgcaguauagagcagucagaaugguaaccgaaggaacuggucuauguaggccaaggcacccucaccuggaaggcauagaguccacuguauguggaccacauauuuuucauccacucaaucuguugaugcugcugugaaugagagcagugaaugugggugugcuagcaucucugugggguaguaacuuacuggauauguacucaggguuaaauuucaaacugaccagcaccugaggugccuauuuaacauaucaaaguagaucuggcccagaucaugcugaagaacauucaguguucuugaccugugugucaucuccuguccagaucuggugagguuuuuuguuuuguuuuguuuuguuuucuuauuuuuuucaagacaggguuucuuuguagcacuggcuauucuggaacucauuuuguagaccaggguggccuggaacucagaaauccuccugccucugccucccaagggcugggauuaaaggugugugccaccaugcucggcuuuuguugaguuuuuaauuuccaacauuucucuuucucaaaaauaugaauuuucucacuagauuucuauuucacucacagugcuggauugauuucucaucuguugaaauagauaguguggugcgggauggaagugugcgggauggauagugugaugcgggacgcagcuggaaguucuucacccauaguguacacgugcaugaugaggaucagggacuuuaaagauacaaaccaucaaagcuuacuuaagcagaaauagguuguccaaauagucccgucuuauaaagaaauugaauauugaaguuaaaaacauuuagccaagaagaauuugaucccaguauuccuacuuuugaauuaugucauacauucuacacaauguuauaugaaaaaauaaaaaaggagggaucauguagcaauuuguuuguaaaaccagaaguacucucuuaaaaaaaccaaguguagacugugagagaauagaacugaacaucauuaguauucuaguuuuguuucuguucuuuuuuuuuuuuaagauuuuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccguuucuguucuuuaaaucagacauuuuugugaaaccacaguaucagaaaaugucacuuaaugugauuucuccuaucucucuuggauaucaguacuuucuaaauagguaggagagaaccuaauagaucccugaaaggaaauaucugguguuuggacaauggauuuuucuuacuccuccauuucuguguguaugagaacacgugcacauguccuguguuugcagaccaaaggacaacuuugaucauugaaauguaggugcuuagggugaggagagaaaggcagggcuuuaguguaaguacuuacauaugcauguagacucuaguguaagccuagugugauggugcauuacuguauaguagauacaggaggaucacaaguucaaggccagccucuacuauauagugacuuugagaccagccugggcuaccuauccuuucuagaagaauggacuguuacgguauaccuguaaugacagcuuucuaggagcugaagcagaaagaucacuugaaucuaggauuuugagauuagcaggucuaacauagcagaaccccagcucaagcauauagguaugcaaaauaagaccauuauauuuuauuuuauuuuauuuuuuuaaagauuuauuuauuuauuguauguaaguacacuguagcugucuucagacacaccagaagagggcgucagaucuccuuauggaugguugugagccaccaugugguugcugguauuugaacuccggaccuuuggaagagcagucgggugcucuuacccacugagccaucucaccagcccccgauaagaccauuuuuaaaaaauguauuaauucuugauaggugggcuggagauggcucagcaguuaagagcacugacugcucucucagagguccugaguucaauucccagcacucacaugggggcucacaaccauuuguaaugggaucugaugcccucuucuggugugucugaaaagagugauagcguacucauauaaauaauacuuaaaaaaaaaaguaucuucaaaaauaaaauuccugauagguauaguuacauaccuguagccccagugcuagaggcagaaacugcucaauagucaauuagccuauucaaaacgggaaguucccaguccugugagagauccuuucucaaaaaauaauugguugaauaaggcacccaacaugcacuucucacuucaacacauguggcccaggugagcacucucgcauacacaugcacacaugcauacaccacagggacauaugcauacaaaaugucauaauucuuaucuaacgguucauaagaaaaaaauaagugcugaacucaguuugauuugcuaaucauauauugcccauucuuuguuuuagagaagagaagcuuaauucuuugauuagaauuugcucagaguguuuuuguuucuucaacuuuguauuuucuucuauauuuugagcaccuaccacaaauucaccuauuugaaucuagcagucuuugcucuucaguagcucucuuguuuugugccugugaguguucuaagcaucagaguuuugauaagugguugcuauuguuuccuuagcuacuuuguuuucuaugggggaacaucuaugguuuauuuuuacuuugauuguuuugacucaugugagugugugugagccugugugaguuuguaugugccaugcagaggccagaagaggguguugcauccauggaacuggacuuacagucaccucugaguugucaagugugugcugggaaacggaacucgguccucugguagagcaucaaguguucuaagucacuggaccacucuucagugaugaucuagucauauuuaaguuguaaaaugaaaaaaacuuugcauugcuucuguauauaaaauguauuaacauucagagauuacauuuuauagcuuuucauuucuguugguauuuugugcacugaaacugcauucugaggucaauaccuuccucaaaucagauacaaagagaaaaucccaaauaaugguguguguuuguuuaugcauguucgcagaugugugaccauccauuccagaggcuaggauggcacaugaagcacucuccuuuguagaagggcccccuucaguuucacauuguguuccuuggcugcuguuugacacagucuaaagucacuugggaagagagucucagugagggcuuaucugaauugcacgccugugggguauugucuugguuaucaguugauguaggaagauccagcccucuguggguggcauuaucuccugcgaaggagaucuuagauuguguuaaguguaagucuucacaguugcauagcacguacuguagccaggaaaccccaucugaaauauauaaauauauauauauaaucuucaaccucugguauauuaaaaaaugguuucuuuuauguuuaguaauaaguagauuuuuuuuuuugguuuuuguuuuuuuguuuuucaagacagggguucucuguauaacccuggcuguccuggaacucacucuguagaccaggcuggccucgaacucagaaaucugccugccucugccucccaaguucugggauuaaaggcgugugccaccacgcccggcccaguaaauuuuaacuauugaaauauuucugcaaaaaugggagacauuagcuuugaaaaauaccacauaucauuucaacaacaaaaaguguuggaauaagugugacuguggguaacgugagucuugccuauucuuugugcaauugaacugcuuaccugggucaguaaguugcucauuuugaagauguuucuuggcaucuacaggugaauggauauucguguuuuuaaagaaagcuuguuuucuuuuauguagguccuuccacagcgacaccgcauucuuuucgaaguguuugaugaaaaucguuugguaaguucugucacacugcaugaguguguagguugcauugauggugaacuucaggagagugguggcaguugggucaggaaccugagaucugagacugaucugagagacuucugagcuacuaauggggcuaugguauuuuucuuucuccuuuccuggaguuaacccucccauuccauucuguucugaaggaccuguccugcuuguuaagacuguaaagucucucucaacgccuaugugacagaagguggggaagggaagccguuuuuccucguuuuccaugccguguacucugaaucugcaguuguguguacugugugucugcuacagugcaccaccuaccggguguguguguguguguguguguguguguguguguguguguguguguguguguguguguguguguggugugugugugugguguguguguguggugugugugugugguguguguguguuucugucaguuucaguccuuaggcacaucauaacuuuuguuuugagacagggucacauuggcuuggcaccuugccaggaaggcaaagcucgccaccucugaguauccuggaagcuguaugccuucaccucuuaucucccagugcugggaauacaguguguaucacugugcccaucuuucuguguggauauugggcaucagaacucaggcccucaugcuuaggaggcagcuccugugguggcuuuucuucagguuuccaggccccguuuuacuguccgucuacucucuucuacgagccugucuacacugagggagugagcaucauucacaaaggcuaggacagagccaaccugagugcuuucauugguuuggcuuugguuuuaguuuuaagauagggucucccuacauaucgcuggcuuucuuggaacucacucuguagagucgacuugcucugaccuuggaacucagucugcaggucaggcuggccaugaacuuacagggacucuccuauuucugucuuccaagugcugagauuacaggccugaaccuccaugcucagccugguuuucuuucauuuuuauaaaauggccauucugccucuugguuuccugaaaaacaucuggaaacuguaauuuucucucuuuagggucuuuuuuuuuuuuuuuuucuuuuucuucgagacaggguuucucuguauagccuuggcuguccuggaacucacuuuguagaucaggcuggccucgaacucagaauucugccugcuucugccucucaaguacugggauuaaaggcaugcaccaccaagccuggccugaaucacuuuuuugacuaacagaaaaacuggauuugggguuggagaaacggcuuagugguuaaaagugcccgaugggcagcuaugaaaaccagauuuuggauuucauuaccaggauagcaaaccagguauccuaggaaugccauguaaauuccagcaacucccguucagaggcgaauggaugcaggaagauugcugcugcuugcugguauuuagcccaccagagaaaacaugugaccuaggagagagacccugccuuaaaggaggagauugguaggggaacacacaucacagccucuauguguguaucugcauacacauguauacauaaacucacaugauuuuaaugaaaacuuuugaaaaagaauauuguuacauuguauaacuuuauuuuuaagaaaugauaauugagucuggcauggaggcacauauuuguaauccuagaacucuguauugagacuuucaggcaagcuggguagucauucgaaggcaaaggcaggcagaucucugugaguucaaggcuacccagugaguuccagggcaaccaaggcuguauagcaaaaccugucucaaaauaaaacaacaacaaaaacaauaacacagagauagauagacacacaccacgcgugagugcgcgcucacacccacccaccagccuuucuagagaguuguaggcaagccuguacuaguacuaggagacccugccucaaaaauaguuaaaaacaggaaaugauaaguuguacuacugacugaugaugcuccguugaaaaaucauaauaaucaaagcagcguuuuuacuuuaacuucacucccugugcuaauguucaugcugaagugacuuucuuguuuguuuguuuguuuguuuuuagagacaggguuucucugaauagccuuggcuguucugcaacucacucuguagaccaggcugaccucgaacucagaaauccaccugccucugcaucccaagugcugggauuaaaggcaugcccugcugaaguaacuuucuucuugauccuugggugucauucaaguuauuuaaauuuaauccagagggcaagacagcuccuuuuauuuuccaccacgugugguuguuugguccuuccuuccagugacuuccaugggaugugauugcuucuucauugucagcaucgguguugucaaacauauuguuucauuaacacauuugagaauuuauaugugugugguucuguacugaguauaaugaucuuggaggggcagugcccuugguauuaguggguuaaacacuguuagaugauaaauguggcacuuccaacuuuaaagcucauaagaaaagguguuuucuuuuuaauuuacucugugucugugugucuggucuguguagcauuacucaguguguagcuuugugcagugcccacagaagguagaagguauuagaucuuccuggggcaguugugagcugcccagcauggguaugcaagagcaugugcaguccuagcugccgcuccaucucuccagcaccaaagcuuaaaaauuuaagauaaauccaaagcuguguauuaguccagaucauacagaucccacagcaaggacucuggaguuccauuagggucucagcucucauuugucacauuagugguaaccccagacaaaucagcaaacaggacauggaagugugugccugucaccgagugcuugagaagcagaggcaggaaaacucauuuuaaggucauucucagcugugcaaggagccaugcuaccagccugggccuguaggagagccuacauccaaaaccaaauuaauuaguuaaacuaaaaguaagacaagggcugggaaaacacucagaaaaauauuuuucuuccccaagacaagaucucacuauguagcuuugucuauccuugaucucauuauguagaccauacuggccuugaacucacaaauaucuuucugucuuugucucccaauuaaguguugggauuaaagguauuuaaugccacaccuggcuguuaauauuuaguuuaauuuaguuuauuuauugaggcaggguuucaugugucugucccaggcugaguuaaaacucccuaggauagcuaaggaugaccuuaaauaucgaucuuccugccuccaucucuccagugcugggguuacauguaugccuccacaucugguggcuuucugcauauuagacaucagucugccaacugagccuuguccccaucuucuugagaauaccgauuuaaacuguuuuaacauuuaccaugguaccuuauuuaugcugugaguaucugcugugacagucuucauguguccuggaauagagcuuucucugaaagugaauuugagcagccagcaggggucggaaauaacgagagcagugugcugagcaccacccacaccucagcucauaacaaguuuagaaaucaugucgaugcauuggaagucguagccacugggcuggccaguccacagcagacucccaacacuauaaacaucuauccuugaaaacauauccuagcagaccucuuuggaaagagaaaggugaagagcacaaguauaauuuuuuacaaaauaauuuccaggcgucuggaaaauguuucccgaaucauguaucauuccugcuuuuuuuuucuuagcugguuuuaaggcuugaggugaugguggcagggguggucuggguccugaugauuaugaaaugaaagcaggcaggauuucucuacuggagguggagagauggcucuuugauuaauagugguauagaggaucugaguuuggcugucagcacccaugucaagcagaccacaacugccuguaacucgagugccagagggcucuuauuccucgggcaucuaggacacggcaccuauugcauauguacaaacacaccugaauaauuaaaaauauuaaaaauaagucuuaaaaacaaguuacauugccucuuuaugaaacacgccuucucucuugagaccuucagcugauuggaugaggacuguucacaucuuggaaggccaucugcuuuuacugaaaggccggccacugguuuuccucuucuucccgucuuuagaaauaccuucaacaauguguagauuggaauuuguucaaacagccucgugcccuaauauaguagucagaguuguuaauuacagcuacuuaccacaguaugucgguguucaagguucaucugcaaucauuagcaucccgagcugcucauauagcauagaugaucacuuuauccuauguguauauaaccagugauccagcagcucagagugagcagccaagcuucuuccacccugggguccuguccauuucucuucagacucuggguuucgacaagacagcagaauacucccagaugagggcugccagcacuucucauuccucuggcuugaacuuggaguugauacuggcccugguaacuacgguguguggcucugcauugccugaggucugagccuacaauuugggcuauucagcauuuugggauuuuaagucaugauugucuagccuuauuccuccaguuucucaguuaucaaagccucucaucuaucauugaaccuaacaaguaaucauucagaagcagccacugcauggaguuaauaucucauguggccaggcuuuccucaaacgcuccauacacugaccucugaucccccuguuuccaccucccaaaugcugggauugauuagagguguguuaccccauaccauguuuauagggugcuggguguguuauccaggaccuugugaaugugagguaagcacuuuaucaacugaguuucaucuucaccugugagucaacuuuaaaaaucaaagcaaacacacaaacaaauccaagcuugguccuugguccuugcuuuauguucaguagaaucagaagaagggaaaaaggggaaaaaaagccugcuuguguuccucacacucuggaagauuaaaucuuaccgaaaagcuguuuguugaggagaaaacaugucagauauucagcauuguuuuauauuaauaaucagagcuuuuucucacuaaguuuuauuccaaggccuguguacuuagccgguacugauugucugacuacaagugaccuauugaauauggcaaacgccuaacuuaauccaaaaaaaaguuagaagaagaaaccagauuaggacuuugcucccauacagaagcagcguaauacacggcaguguuuccugaagucuguaaaggcauaacgggcuaagcaaggguaauguccauuucagucgaacaaaaccuaacagauuccagucuguuaugguuaacugguuaaaaauacuguuagaaaauuggaauucaaaacagaucugacuuaagcaguuuucuuuuuuaaacaaaguauauguuugacacauuugcuuuuacuuaggaaaaaaacccuuaaguuagaaaaaauacagcuuggguguagugccauguaguguaaauaacucaacuauuuugcuaugaaugggccaguauauacuuauugcuggaguucuugcuauaaaauucagguaagggguuuaaauauacccuagaguauuauuuaaaaauaaauuugcuucuuucaaauagaauaccaaccuuggucugugacauuugggagagaaauuaaaauauuaagccuuuauugccgaguaagcugaaaauacaguaaagguuauguaaacauaaaucagaaauauauaucuauauauacagagaaucaccaccucugaaggacaagccgucuacuguucucugcugugagaguuuuaucaguacucguaauucuaccucagaggccaugcuagugggcaaagauguaaacaagggccugccuuguuuauauuaugaaauauguggccugguuuguaugucuugucuuuauaggugucuaacagcugccuggguuguuuuaaagcaccaguagggcccgcagaggacucuccgagaacaggauugccauugagauauguuuauuugauguguuaaauccuuuuuaggcuucuuuacuuaccacaacacucucuuuaagugaaugaauugcacacaguggaauaaaauauccaauguguucagacuauauugggguguagcuuuucugucuaaucugcauauguuuuuaauggaauguuuacccaggcuauuucuuggcaggauuuuaauagucaaaauauaaauggcaucauuuaaagacuguacuacuuggcugcauuaaacguuaaaauuacaggacaaaaugguuggugacagcuucuccucagccuuuuuuuaaaaauuuccccuugaggagguuauuugguguuuacaacaauguuacugggcucguuuuguaguucaguuugucaacuuucacuuucauaauuguguuuugcuaaaauauuuaccuuguucaauuugacgguuaggcuuuaugccccucaccccacguuuuuguauuuccaaguuauucagcuguuuucauuuacucauuccugaaaaaauauuacaguccgcguagucccugcauuaaaccugacuaaaucucucaguauggccauauuuugaaauucaaucuuuaauuugauacucaaucacacagguuuuauuuguacccauuuccuguaauccuauagcauucagugaaaauauuagcggugaggaucaccgggggaaguuguaggcacugagauuucgggaguuaaauguucguuuuguagggcuggggugaaaaacuagguuucccaguugaaauugaagaagcuuguuguucuugcguuacucauucaugcaaauuggcgaagguauaauugaaacaagguuggcuguguuugagucagggcugcagcugagcucagcuuaaaggucgcuggaaaucaagugcuuugucagugaaggcguucugacucccggcgauucuagacacuuggggaacgucaaucucgggcaugggucguccuuuucuaugaaaucugguaucugaaguuaaagacgccuccccacgagcuuuuucaacaccgccgaugguuuuuuccucuggaugcagcacagcugcgcuagccugacuacagacagagcucuuuguuuugacucucagcccugaacaugcuuggaaaugagaacaaauggcacagaguuuacgacugcacuuugccgccagaagaagcaagacuuacccucugucggaacccucuggagaugacuuggauagccacguugacacacacggccagaggcggccccggaucucaguggcuagugugguucaaaugaggcugacccccagacaggcgccacaggcuccguggguagagcauagauccucugaaaguacugacaaaaagagcagcugccugcagaucucacugcagcccagauacggagggugucuuccaucugacacugucguggcugauagggacaguacuuccucuaccugugcuucaaaggaugauguuugcagcagcaguggaauugacagugagcuggacaauggcagccucaguaacuucucagccagugacagugggucuuacagcagcaguggcagugacugugggucuugugcaagccucgcaaguggaggcuccuccaccggcaguggugucagcgacaguaguggcuaugagaccuuuuucaguggaaauuuaccuucugacaacgccuccaacagaagcgugccagucgacacuacaccccgugaaguuaugugcggaagucccaguagacuucccuuugcccaggaggaccuggaucguggaguagagauuaugaaacugccagugaguaggaacgcaaaggguccacugaagcgcugcacgucuuuggucauuuuccccaggaguccuucaaacaccccaccagcauccccgacgagcagaggugccuaccagaccucacaccaguugguuguaucaccuacugaaacugcacaucaugaagauggaucuggcaccaaaggcuuucugucaacagcugucaacgggcuucgauuaucuaaaaugguuuguacuccuggagaagucagagauguacggccacuccaugccaagggcucauugcaaaagaaaauugucauuucaaauaauaggcccaaacaaacugugugugagaaguugccagaaggauuuuccuguguuuccgugcacuugacccaacaaaaaccaacgacaucagauugugcaaacccccgugguggcugcacaucagagagguuagaacuucagcugcagucugauuuggaccauggcaugcucaaacagagggcauccccuugcuugccaaccgcaucagacauggguuaccauuuaaacauccguggagaguuggaaagaccaaauucaccgauaagcaaaggccaugcugcuuugcaaagaaguguuucgcugggugggacauacccaaauauuuccugcuuauccagccugaagcacaauuguucaaaggggggaccaucucaguugcucauuaaguuugcaucugggaaugaugguaaaguugauaguuucuggagacagagagacuugacaaaugaacugucugauguuuguaagguaagauuccucuggucuugaaaaaauacuuccuggaauucuuagcuauacugauuauacuugauuauagcacuaucuguuccuuucuguggcccuuagugaggaaguuuuuagaaagcuucaauuuuauauuuguaaagcucuuucuuauuuuaccaauggauaaacuacuuuuaaaacaaacaaacaaaaaaaaaaccaaaaaaaccuuuccuuggugauuuaaauccuaaaauucuuccagaacuggcucgaugucauaacacucgaucuugggauauuuguucuucuuaccuucagaaaugggauuuucuucucccucuuaaaacacauguauuuguaagaucgcugaucaaaaagacuauuauauugaauguuucaagcagaggaaaaguaagugggcuuugcauuuacauacacccuagccacaggaaugcuguuugcacccuauuuuuccugaguucccagugaucgcugucucccaaaauguaacucacuuuuucagcaguauugauuucuaaguuuuauguguuugaauuggcuuaaacguacuagguaguuucuauaauuuucaauuuacuacacuaguuuauuguucucacaauguugcuuuauuuuauuaguaauuuagcucuaacagaucuuagccagauuggcauuuuauguaauuuggccuuuucaaauuauuuacaaucuuuaaaacuaaaguagccuuuaccaugucuguauuuggaagguuuugcaaaauuccaggaaauuuaauuguuuuucugacgacauuagcucuagauugacaacacauaugcuggcuggcgugcucuauuucuuucuugugaagggaccuugcuucuuuucauggcaaugccuguauuaaauguuggaggaguguggggggaauccagauaaugucuagacagauggaguuagaaaauuagguaauugggcucuuuuuucucucuuuugaaaucuggaaaauauaaucauuguguccacccaagguuaaucuacgcagcuacuucacuggggauaagagaagauuagauuucaaaguuugaucuuuguuuuagaguuauucauuccacuugcaaaauuuuucuaaaacaguuuuuggaacauuauaaucgguuuaauucucuuccccaaagugcuggguccuuaaagcagcauuaguacucugccaauucagucgauguuacucacagagucuacauucaaagaaaccuaagaaguuaugaaucugaaaagaauucuagaaauaguccagagacagucguuacuguggcagcacuaucauuugccacugaugcuuuccaaagagguacuuuaaauacacccagugaaguauauaaacucaaugcuguuugcaucgcuaagaauguuuucacaggccuuuaaauuuucuagcaaacuaacaauuacugcuuuguaacaaccuaauccuagucucuuaguuguaaaaaaauacagaaggugcuauuugucugagaacuuuaaauuguucuucaacauguauuaaacauaaaaauaguauaagugacauaaguuauauuuacugucuacugugucuaaauuaauucacuuagaaaugacaaauugagugcuuaugcuaauuccuuuucuaaacacggaguggccacaguaaugacauuucagaaguaauggcauguuuaucaauaauauauuaaucuaauuauagugguuuauuguaacuagcuuauaaauaaacagcucccaaaauauuucccaugucuccaguuagucuggguucguguucagaugugcugagacugcauccacauuuaacaaguugauacuggagucgcccuugguaaugucagccaucuguacugaguagcagugaaaucagauaacagcuuuggucagagacccuggugaggcagagaggucucaagucucuucucuuguauuuggcuaugagcucacagcagccucuucucgaguuuacagcucucuuauaauccuagcuuguaaaugacuaauguuuaauguguaguuaggacuuuuuaccuguaucuaagacauaggcuauccucugugcuuacagcugagacugaaaaaugguuuccuaaaaccugccucagugucuauuucaggugcagcaaaaaacaaccuuugggggauuuuuuugugguugggucucuuuuugcuuuguuuugugcauuucaaaugcaauacuguguagguaaaaauauaugguggccuuugaucugccaggagaaguuuuguguuucuuuggucaguaugguaguuugucaguuuaaggagccaaggugacauacacaguucugaaaaugaauacugaacuuucuaaagucuguaguucgcuuguuuauuauuaguucacuuuucccugugucguauguucuaaaucucauuguuggugcugagaccuuccauugccuuguuuagaauccuuccagcuccacccuggcuuggaugugcuuuccuuccaucauccagaaaugcugugcuuuuuguuaugaaaggguuuccugcuccucgucuaguacuuaacccuagauaagcauauugcuuaguccuaaaggaauagauccugaaauaguuuugucuuuuuuuuuaaagauuuauuuauuuauuuauuuauuuauuuauuuauuuauuuauuuauuauauguaaguacacuguagcugucuucagacacaccagaagagggagucagaucucauuacggaugguugugagccaucaugugguuguugggauuugaauccaggaccuucagaagagcagucagugcucuuaaccgcugagccaucucuccagcccuaguuuugucuuaauuauaauguucaccauuaaucuccagaugauacaauucaguaauuuuaaaauaauucuuucugauaucaaaagcccagauggguauuucagggcaggaauucuccaacacuguuuauauuuggagccagguaaauuuuuuuguggguggggcuguuuuuugcacucuagggugucaagcagggagcagccugaccauccgacacuagaugccacuugcacaccccaaaguguaccagucaaaaauggcuccaggcauugccacguguccucuugggcaaguugccuccugguaagaauugcuacuuuaggcagaagucuugguguuugaaggccagaaaugugcaagagccuuagguuguaagucacucagugugacucacgggagaggugcagaaggccugggggagccggggggcaugaugcuuagguuggagcuaaaguaggccugcaaagaaguccuuuauguccuguuaacagaccacacuuaguaaauagacaucuuuauguuuuuuaaauaaguguggggguaucugugugucucagugucuguggguuugccugccugccugcaugucugugguagguauguauaugugaguuuagguguccugagacuagauaucucgaauccucaggagcuggacuuguaggcuguugcgagcuuucugcuuucuguguucuggggaauccaacccagaccuucuauaagagcgguacauacauagucuuaacuacugagcuaccauuccagccccaucacuuuugugcuuuaagauaauuauuuguggcaccaggaauuuaagcuacucuaacuuuucuuaccuugugugauuggauaaacacugaugcccugaaguaagggaguacaggagguaagaccagccugagccugaguggugcagcagguacagugagguccugguagugcugcuggaggaaugggagcugagcccauagaggagcucggaaucuccaccaauagggaggacugugcucaaaggaucaucucagcugggccaugcaucacaugaaacacaguggggaccacuaauuaugaggacaggguaaaagaagauaaaagggagacccagugagcuccuagacuggccaggagagguugaugacaugcaggcagggaagggccagcagaaagcauaugccucuacagagaacuucauucuccauugcaugcaguaguuaggagcucauuggugacuccagcaaaaguaagcuaggaaaaucccaggguuagagcccaaggugaaaugauaacauagcugagaacagcaagcauagaugccauccuacaaugagugcaguguagaauagucagguacgguuuaaugauuguuacaaauaagacucagcauuuugugauuuaagauggaauaagacaaacuacaucccuacaaagaaagugcugucuuccccaggaaugggaggacagggcucuccgcucuucaccuuggcaccuuagauaggaaaguaugggugguaaaacccagacuggauucugucaguguuaugugagggaacagaaaacuguauaugggaacucaggacugcaaugcauagccacaauuccucuuuaagaauaucauauuuuauuaagagaauuucaugcuuugaccauuaucaccccuuugucucaauaacuccuuccagaucuacuuuuacaaccucuucccccucccaccuuuguauccccccucccuuuuuuuuuauagcccacugauuccauggguguggccauccaccggaguaugugaacaacauugcuuugcuuuucucagccucucaucugacaccaaaaauaacauagagcugacaagauagcucagcagguaaaggcacuugcuguugaccuuaguuuaaucccuggacccgcaugguagaaugagagaauuaacucccacaagugugcucucaauuccacauaugcacucugacauacuccuguguguccauaugcaaauugauaacuauaauaaaacauuuagagaaaauaaaaccaaguagagccucuauguagaauugagccaagguuuuuaagguuauggccuaaaaacuuugggauagggagccugcccgagcuagcuguuguaaacuuuacugcacugugauggcugacaagacaagauuagaccugggcuugggagcuuggccaagcaggaggcuuggcagcauugcuggguguggccaggccacgugcugagguugagagcaagauuaagggaagggaaggcugggggguggugaagcaguuaucugucagcauaucuucggaguguccaaagccuugcugguaucuucuucaggcuuuucuugugggaagguugugacaggugcuucaagaucaaagaaaaauguuugaaaacagccuaggagcugucuagucugugaucugaucugggggcugucaacauggaagugguugcugaaagcagccucagcuuuguuaagauuuaaaaggcuucugggauauaaucccaccuagcagcaggucugaguguggaaagagaagcauuuggcauggcacugaguccuguagcucagcucaccagcuauaggaaacaccucucaggaggcagcucacacauuuuuagauagguucuuagacgccuaugggagauaguacagagccaugagccauggugcuuucuagaauaaauacguugccaaacaaagaauuugcauuaagaauauuaauggugaaugaaaaugaggacaugagcauucccgagcaugguugaggauaggguuguauuguuggccugagggagagcaugccuagagacagccacaggguccagaauaaacuaggucaugaaaacaguggggagagaaagagaauggaggaugaaagcagaccaagaaaggaucugccugcauuugucugaguaugggaauaacugaguuccagaaaagccagggcuguguagagagaccuuuacucaaaacaacaaaacaaaacaggguuucucagugcuuagcuucucuaauguaccaggaugggaugagucugauguuucugucaacacuuagcacugucuacauucacgcucaagaauuuagaaaguggacagcuggaauucaugauugaauaaaacaguuucacagaagagagaaaauaggaauuuaaagaauggguguauuacuacucagaucuucuagacauaagucagugcugacuggaggggugagacuugaaaagauaagcaaccuucguaacugguuggaauugauggcuuuuuguguguggcaauuuagauuaguuuccugauacuguguaaguugaccaacacucagcuuauauucagauauuuagacccugaguauccacagcagagaggcugcauuuguguuugguuuguugucaaucuuaaugacaauaaugcuauccagacuuuacaaccuuaaaugguuaaguauguucuuaucauaugguggcauuucauuugaauugaauuugcucauggaaauaguugggcacuaaccaaaaucugccauucggaaacacuugugguauuuuauuuuuuucauuuauuuguuuuuacuugauauaugugagugauuugcugccaugcauguuaaguguaccauguucaugucugaugucugcuaaacccucucucuagccccauugugaguuccuuuaagaaugguucuuauguuacauuuucccuuuucaacacgaggacuguuggcacguucuguuuucuuuaacucuucuggcuuauuuaagcaauguuuacauccucgaagcauucuucagguguggcagucaagauaguacugagacugguuaacucuuuuuuuuguuuuuuuuuguuuuuguuuguuuuuuguuuuauugagacaggguuucucuauauagcccuuucuguccuggaacucgcuuuguagaccaggcuggcggcuggccucaagcucagaaauccgccugccuccgccuuccgaguggagugcugggaucaaaggcgugggccaccacgcccagcugagacuguuuaacucuuaaacugcacuauguaaucacugagacauuguauacucuaugugcacaguuguggcuuuuccuuuugcuacuuuaaaggagaaaguugaaaaaucacuuuuuuuuuguuuuuguuuuuugagacagguuuucuuuguauagcccuggcuguucuggaacucacucuguaggccaggaacucagaaaucugccugccucugucucucaagugcugggauuaaaggcaugcgccaccacugcccagcgaaaaaucauuuuuuauacuuucauaguguuaaaauaauauauuacuuuucaacucuaaaucaacguuaaaaauucuuagaaauugcucuuucuuuagagcagcuuacaugacuuuauccagggcugcuaggaguuggguucccagcacccacaucuggcagcucacagcugguaguucacauugaaaguguugauuacugaauaaagucauggccccuuugggaugagguggagaggaucuugcuggcuaaggcugagcugacagccuggcagggacagaaaaccaaucuaggcuauuuaagugaugacuggacgguucuccuaaaugaauaucgugucccugggcugagugccaauggaauauugugauccugagucaaggauuaguuuccacaguagacucugauucauagccugcacauuccacucacugguaaccuagaacuuggugucugcauaaaagccccagaucaaguuuucugcaaggaaaauugaauggagaaagacuugaaaggacauuucagcaaaggccaucaggcugccucacaguuaucauuguucgaguuccuccaagccugaagcugggauccucugaguaggugcuaguuucaaaugacuauuuuagcuaagaaugaccuucgcccucuuacggggucauagaccuuaauggacacucaagucaucuucaaagcaaaugcguuugacuaaaguauuuaccagaaacugaacaccuuguauuauugcccaauuuuuagacacagugauggacacaggaaaauguuuucucucuaugcaauauauaacuguauuaacuuaggguaaaacguauuuuaaaaaguaauauuuacuuaaccugauucucaaggugcuugugggaauuaauuugcaauacauaaaauuaccugaccuucacauuuauugucugauuuaccuagguauauucuggaaguauaucuaguccucgugacuaauucaaauaugucucauaauauuaaaauauuauuuuuuuaacacacacugugaccuuuugcauucuugacaauaugcuaaguauaagcaugcauuccugccacuuacagccauagaaccauuuauuagaaauuggucagagccgggccaugguggcgcacaccuuuaaucccagcacucaggaugcagaggcagaaggaucucuuugaguuugaggccagccugugucuauagagagaauuccaaaauacacaaagaaaccuugucuuggacaaaaccaaccaaacggaugaauguaauagaacaagaugguucaaucaguaaagugcuuguugaauaagcaugaggacggaccugaguucaagucccaccucacauagauuaaagugggcaugguagcauaugaugggaagcagagauaggcaggucgcuagggcuugcaggucaguuagccuacucaaaugaugacgcaagauucuggugggagacacugucuggggaaaaacaaagaaagaugggugauggcuggggaaugaaugaauuugagaguguccugugguuuccauauauauaugcacacauauacauucccuucagaguaagacuaggaaagguaccacgauggcuuccugcuaggguuugguuugggaugcuuaccaucauuaugucaaaaagacucagcuagaauuuuuaaucuugaaggagaacuugccauauuguuccacagagaguuaauuggugcuuguauuucauauucuguguuuuagaaacuugccaaacaguuaauacuucugcaugggaaaugaaggguuaaauaaauguucacaugccugacuugggccccacagacugaagcguagugccuccauggucuaauaguguuccugcucuaccacaggcaaacagcacuuuaccccugcaguaggagaacccaacuggggcaagcugcuuagaaaagguuauuuugguaaaaaucacaccagaaggaaaaaacaagugucuggaggaaaaauuccaucgugaugacuccgaccugaugaauaaugucccagcuggguagcguguggcgcaggucaaguccauccuuccugcaguuguugagugacaggaaaggcuggagaugucagcuacuguucccggauaauuaacuucccuuuuaccuguuugguuguuuuccccaucuuguggccaaaggagugaaauaguucauuuuguugauuacuuucuguuuuucauguguguggaugggcaugugcuuguggacgcucagguuaauguugggaaucaucucaguggcucccccaugcuacuucugagauagggucucucaauccagccuggagcuugcugggaguuuugcucccagcucguuugaaggagcccuacuucuucccaacauugaaauucuagguggacagccagggcagcuuggcuuuucuguagguuccugagccugaaacucugggcuucacacuugcucugaugaaccuuacugccuuuacugcagccagccagcuccaucacuuacaaccucgucuguuaauuccaggcucaugcuccucagggucucaugagaacugcuauuccuguuuccaccaauauuauaauaaacccuuuuaauauguacauuuucagaauacacaagaaaguauaagaaauaacauggugaauggauguuucaccuucaaguauugucagcacuuucaaucauuuugcccaucuucugucuucauuuuuuuacuuacuaauuuugucuuauuacuucccuacaucauucuucaaggauuaugcaugucacugcuugucccaacaguuaaauuuugcuuuuuaauauauuuugcuguaaaauacuucaauaugucagccuacauaaaaaaccaaaagauauuuuauuuuuuaagauuuauuuauuauuuuuauauguaugguuauuuaguugugcaugugcaacauuugggacauguauacaugaguauguguguguaugagagugugugugugugugugugucugucugucugucugugcuauucuguuuuucuaguccgugagacaggguuucccuguguagcagccauggcugucuaggaacuucucucuguagaccaaggaagcuuaaaucucuucucuaaaacucggagaucugccugccucugccucccaagugcugggauuaaaggcauccaccaauacugcccaguuuuuauuuaaaacuugcauguuacaaaugaagaaaggaauagaaacuagauugacacaagauuggcaggacauaguccugaucuaagccuucagaaguccagucugggguacacagagaacuuaccaaauuaauauaguaucguaucauugauaacccuuaaaugaacagcacuguguaguccacuuguguucacugcucuuuaauacaggucugcaggucacuagauuauggauuucaaguuuguugacuuguaaacuggcaaugaagauagaguuaaccucaguuaaauaaugaggucauacuaugugcagugugguguggcuuacaaauuguuuuuuguuuguacuuuuugcacauaccguauucaugagagugcuccugacgucauggugcuugugcacauggccacagguugauauugaauguuuuccucuacuccccucacugaaccuggaggucacccauuggaccagacugaauggccauugaguuccagggacccuuccuguccucugcucauagugcuagacaauagguucagagucccauagccagcuuucuuuuuuuuuuuucagcuguauuauuuuuuauguguauggguguuuugcuugcauaucuguguacacugccuacggagccuggaaguuggugucauauccccugguucuggaguuacaggcauuaguugugagcuaccauauggguucugagaaccaaauccaugucaccaaguacucguauugcugugcugucuaccccaacacaacuaaucuuuauguccgcucuggggaugcaaaugcagaucuccaugcuugcauagcaaacacucucaacccagucaucuuacaagcccaaggaauuaguuuuaaccuuuauuuuaaauauuuaguauucuuaguugaagaaaguguaaaauguuuuaucuugaguucuaaauuuuaccugucaaugauguuuuuuuuuguuguuguuauuuuuguuuuugagaucaguguuauaauuucagugaaguugaugcuugcuguauuauaggucaacuucaugaccuguuaauauagccuguuaaucuguccgacuuuaccaacaauaugcagauucccuguggcuguuuccaucuguuaaagauggagcugaggggcuggagauaugaaucagagguuaagagcacuggcugcucuuccgaagguccugaguuuaauucccagcaaccacaugguggcucauaaccaucuguaauggaaucugaugccuucuucuggccugcagucacauaugcagccagaaugcuauauacauaauaaauaaauaaaucuuuaaaaaaaaaaaagaugggugaggcucguggcacuagggaacagggacagacaggcaugucuaggaaacacauggaccacuuuuuguaaagauaaaacccuauuuagaccuggguuuaauucccagcacgcacauggcagcccacaacuguaacuccaguucaggggaucugauacccuuacacagacacacaugcaggcaaaacaacaaugcacauaaaauaaaaauaaauacuucuuaaaaauuaagagagggauagaggaaagcacccuguuucaacaugucaaucuccagccucagcauguacucccaccuguggauacaccgccuucaguuuagguaaacuuugugugaauuguaugucaaagcuuuuaaaaaaaucuuaauuuauuuucaauuauuugucuguagguauggggcgagagugucagagaguguagaacugggguuacagguacaaaugugaacgugggcaggcucgggugcuaggaacuuaauccaggucuucuacaaaaggagcaggaagcuggaagagggcauaggacccucuggacuuggaaucucagucguuguugcuaccaugugaaugcugggaaucaaacccucaggcccuuuugaauugcugagcaaucucuucagcuuuuguguuaguucucggcuuugaacucauggccuauagcuuguagagcaaaugcuuucacccacucagcugcugcccagccuacagcuagugacuuugaugcucuuucccucuuugaaccugaccuucgcuccuaugccuuuccuuucacuuugugcagugcuuccucccacauguccuaccagcccaccgacggcaaucuugucucuugucauccgccauaagccucuuguuuuccuuuuaauuuugaaggauauuucuuugcuagacgagaauucuagauacuugauguacuggcuaguuuugugucaacuugacacagcuggaguuaucacagagaaaggaacuucaguugaggaaaugcccccaugagauccaacuguaaggcauuuucucaguugaucaagggggaaaggccccuugugggugggaccaucucugggcuggcagucuugguucuauaagagagcaggcucaacaagccaggggaagcaagccaguaaggaacaucccucuauggccucuacaucagcuccugcuuucugaccugcuugaguuccaguccugacuuccuuggugaugaacaguaguauggaaguguaagccgaauaaacccuuuccuccccaacuugcuucuuggucaugauguuugugcaggaauagaaacccugacugagacacuugauaaacagcauucuuuugucuucuugcuuucaguguuuuuaauggauaaccugccauuauuuguauucuuucuuaaauuauguguauaugggggcuagagagguggcacaaauggcuaagagcacuagcuccuccuucugaggauccagauucaacucccagcaccugcauggcaacuuacaggcugcaacuccaguuccaggagaucgacaccagcuucuggccucccuagacacugagugcauauggugcacacacauacauacauacacacacauauacacaugaaagugaaacacucaugcacuuaaagauuuuaaaaauugguguguguguggggggggggguguggggguccaugugagugcagaugccuguggagaccagagaaggaaucagauacuguggaggaggagguguaggcaguugugagccacccaguguaggagccaggaaccacccugggguccuuagagaaagcagcaugcacucuuaaccccccagcgucucuagccccaccauguauauuuuauuuccugugugcagugguuuuugguguuuuguuuuuguuuuuaaauuugguaucuuucaagauuuucccguaauuucuagcauuuaauaaugaugugcuuauucauucauaauuaagaguuaucagcugucaguuuauugaaauuuaagcuuuuauuuucucaaaccuggaaaaacuuugccuacuuugaguuuuucaaauaauuuucugccuagcuccucccccuauguuguauguuucauugcguaugguuccagauggagaggaaguaaauugugcaccuuuucuuggaagacuguugacucucagucucgcaaacuaacuaacuuacuggguuacauugccugagguuuauacucuugucuuuugaaucuugugccuuuaaggagggcgguucagggaccauugagggucauugauuuuuguuuuuuuccugcgcuuucuugccuacuuuucuauuguguuguuaguuccacacuuggcuuucccaccgcucaagccugaacuuugcagauguuugcuuaaggacugaacaguucaugugugaugugugguugugugccugguuccuccuaccucuacugcuauucucuugugcguuggugugucuauacuugccugaguguguagugauuaucugcaggacuggaguuucugcugugccacccgagaggguaccacaucacucugcuuuuguuugccauugacuuuccauggaugcuucaguggauuuaacaacuuacuuuuguguguauguaugaugguuucucaucaagugaauauauucguaaugcucuuuauccuuucuuuuacagacaagagaugauuuccuaggucaaguggaugucccucucuauccuuuaccgguuaguauuggcauccaugguuuuggguuuuguauuugugauuuuuuucuauuuuaauaacugcuaaugugaaucuuuaguauaucagcuguuuccugaaauauaucucacuuuuccuuuucacucaucuccuuuccuuacgugagcuucaagaaacugaaccacagggauugguaggcaagauggagccuggauuuuaagggcuuggaauuauccccauaaacagcaagaacuugggcucacauacuggaugugagagacuaagagaccgaaggaccauuaacacuccugagaauggaguuggaaacacaagagugggaaaggcuuagguagccuuucagaaucaaaugucacugggggcuugcagagauggcucagugcuucaugggacugaucagaggccucaguucccugcacucaccugccagcgcccagccaccagaaaccucacuuguaugggauccggugcccucuucuggcuucucauggauccuguacacauucagugcacauuuuggccauauuuaauucugauaagaaauuguagaaauuugaaaguuaaugugggcaguuaguagcagcauauaagaaaauuguguagggaaaagaaacaggaaggguugagcguucuuggugucuaaaugaaggaccaggugcaaaaccuuagucaacauggguggaucaaaagaaagucagaagacagaguagaaagaaccaaagaaaauacuuuccaaaaacuauaaggaaauagcuucugauugugcauggucuuccauguaaauacuuggaaggaggcuaaggcaggaggauuacaacauugaggccagccuggcuuuauagugagaucuuucauguaaauaacuuucaaggcgcagaggguagcaaagccauagagaaguaauacaaagcaggggguugcugugggaagguggccgcccacacuccucucaacguuggaguuuuugcuuuuguuuuagaauucucuguauacucuuaacagagucaagcugcugacauaguacauaucccauguuccuuuggggcaggguucugcccauacuguacuguccucuacugccuggguccugccugcucccacaucucagccuaccccccuacuuccccgcgcucccuccccucugcuuguuccccccuuaguuauggaguuugcuggaguuccugugcaggaagccaaagccaugugguuaccagcugacucuuaacaaauuaaaccuucuuuucucguucuucagucugccuuucauuauaguucagcagugcuuuccaaaguacucaacccccuuucucauuuuagacugaaaacccaagaauggagagaccauauacauuuaaggauuuuguucuucauccaagaaggucaguaaauauguaagauuauaguuuauuaagguuaauaguuuugcgauuuuauuuuuauuuuauguauauuagugucugccugaauaugcaccauguauaugcaguuuccaaggaggccaagagaaagugucagauuccuauguggcugcuaagaauuguauguauguucucugcaagagcagccagugcuccugaaccauucagccaucccuccacauacaguacacauacuauagauuugugucuucauuaaaccuuacucuccucuuuaaaaauccaggauuuaaacacccuauaaacaagcuauuuaaauaaauuaauauuauuucuuuuaaaagcuuuaguuauuucagacuauaaaauaaacucaaguggcuggaaaacauggcucaauuguuagaugugcuugcuacucuuucaguggacccaacacacaugcacacacacauacaacacacaugcacauacacauacaacacacacacacaugcacauacacauacaacacacacacacaugcacacacauacaacacacacagaaucacaguguacuuuguucauauuccaaauaaaauucuuaaauagacacaaaaauuaggaaugauuugucccccuuauuuaucuaauagcuguauuucacguaaaacaaauguccagcuugaucgguacaaaaacaaauucagaauuaacuugaguauauuuugcaaaauuuaauuucaaaaacauuuuagaagauucccauagagaaacuagcaugaauagugaauaaaauuuaaacccaguaaguacgcuuggaauuccauuuuccugaacugaguuacuugguuccuuuuuuuaaacuaaauuuaaucuuuaaaaaggaccuacucacuuuauuuaauguguaugaguguuuuaccugagugcaugucuuugcaaugcaugcauucggugguaaaggaggccagaagaguguaugagauccacuggaaugggaguuagagccauauucgagccgcccugugggcgguggaaacugaaccuggaucccccgcaaggucaaaaggugcucgugaccacggagccgucucuccagcccuccacauuuaaagucuuaaguucuacaugcaacuccuuauggucuuuugugccacuuggccaauuaaaaucaauuuagaauguguaauuaauuaucacauguaaaaguaacccaucugggaaaaccauagcacuugcuuuaugcuuucuaacaaagaaaugcauugaacaguguauuauggacauuuaaaucuuuuucauuuaaaaauggcugcuuuaaccuagucuuuguaauauaaauauuaaaacaacauaaaggauuuuugguuuugugguugcuuauucugucugcgagagaaggccucuguuccugucgaagucuaggaauugaaucucuuuucuuccucucguuuuggaccgauugcaauaugugcauaccaagaauaacuaagcaaauauuuucccgccuguuuugcucgcccugcucucugucccucagauugcuguaaagacauuucccgaguugcugcagacccuaaagcagauaaauccuuucuuugugguguucaaguuucauuaauaauuguuuucuuuccuucccacagucacaaaucaagaguuaaagguuaucugagauuaaaaaugacuuauuuaccuaaaaauggcucagaagaugaaaaugcagaccaggcugaggaguuagaggugagauucccaggaauguuugcuuaggcugaaauggggcugucugauaucguucuugguagaaaaccaugguuuucaaggaaacugaugcaugcaaugaaaaucaccacgauguugauuugaccaaauguuccuuaagcaguucucucucugacaguauuucuguagagugguuguuauugguagacuuacagguagaaauaggaaaugcaauauuuaucaaugcagguguuuauuauaauuaugucauugucuuuagguuuuuuuuuuuuuaaaaaacuauguccuagucuacuuuacaauaagaaaauagguguuuguaagcuaaaucuauagacaucguacuauguuaaaauugcucuguuucuauauacuaauuacauuaguauaaaacucgaaggacauuuaauucauuuugcuuuucuugucauguuuauuugaaguacauuuuaguucaugguucucacaggugacaggauuaauaaagaaucaaaccaggugccugaacagagccacacaucugggcacugaagaguagcaggguggcuugggcuuugauagcuagcugagccccuggagcaagcuagcucugcuucccacagccaugugaccucugaucugcuagguuuuucuuuugugggggagaaggacugcaccaggucgccuuuaggguuucuucccuggcuuuaaaaagacaaaaccaccuccuuucuguggugcccuuagagacaguucaucaaaagguuuaaauuuaaacauuuauucuaccucacacuguauguguguucugugugugugugugugugagagagagagagagagagagagagagagagagagagagagagagagagagacagaggcagagagagagacagaggcagagagagagaaugugcaucuaaccugauuguucuggaagguucuuucuuguguaugcuuucuuccaggcuugucucucuuugguugaggguuugcucuggucucucagagcugugagaccaggggauaucccugaggugugggcucuagcucaugugcuugggugccuugagcaggaaaugaauuagcaaagcuuuugguagucuauguguuagugagauuuuacuuuguaggggaauguuugaggguagaaagaaaguuguuuuuuccuuaaauaauagaugauagaugaccccucauugaugacugaaacuugucaccguucucuuaaauaaauagauauccccuccuugauuaccuuuucugcugaucuguuugucuuuguuuuuaauuuuucuaauauacauuuauuuucucugaauauuuuauuucuuuauuuuauauguguguuuauauguuagguuaguguaugcuugguacucaugaggucagaggugcuguuuuagauccacuuggucuggaguuacagguaguugagagcugcuaugugggugccggaguugaacccagugaguggucuuaccugcugugucuccagccccuguucacauucauuccuuuuuccuuccuccacggagugugcucguggguuugugcuugcucgugugcauggguguuccguagaacacugcagaagucagaggacagcuugaauguccccuccuuccacugugaggucucaccuucauucacagugccuuuauuguggccaucucacuggcccacauugcaagcuuuuaagagauuuuuuugggguacaaaugucuguccauggccuugucacgcagagggauucuuacauuuggauuucugcuugaaaugaacuuugcuaugaaggaagaaaaggcuuucccagagacuuugaaguuuagcagcauuucauuacaugggagcucgccccagcuuugcuugagcaugguucacaggcaccucauucaugguuugguuugccucugugguguagacucgccuugcuuuaugcuuuggccucccaucacaauguuugaauuccuucagaggccaccuuauaauuucgagagauguaagcgugucguuuguuuaugcaaaggccgaggaauucagacccacgaaugugcuuauuuaucuucugggcagcgagagaccagagacgucuugccugguccugugauguguaguuugugacuacauauuucaaauucugcuauuugaaaaaaacaacaagugcaauuuuggagggaggugagcucugggcuucuuacauuucugaguauaguguggcucugauuagcuguguguaacguuucauuuuguguuauuuacgaucaucuguaugaauucuacaagauuaggauaaaauguuugucuaaguacuuuguacuugcuuucuggcccuucugacuccauuaaauuguagguauuugcauauuggcuuuaagacuaguaguuaggauuucuugccuuguagaaaauuauuuuaugaggaaaauagauaauccauauuucuuagggaagacagaaaauauucuuucccaguaguguuuggggguauaguuguacuuucucaaacuuaaaaccauuucuuuuucuaaagcauuaaaauaagaaauuaaguaccuuuuuuuuuuuuccauuuuucuuacugaauuuacaugggcaacacuaaagcagaucuuuaaaaaguaauacacauuuucaaagaaaugcucuugugccagggaagcagcuuacuggucacaagccagaagcuccaaguuuaagcuccgucuucagcccacuugaucguauuccucagcaagaugaauccccuggaagccuaaggcccagcuagcucagugccagaggcagcaagaaggaacccugcauaggagggggaaaggaaaggaccagcuccuacaguagguccucugacccccacguacauggcaugcaugcacccuuacacacuuggaaugugccaaaggccaucagcccucccugcacugggcuucaggccacuggugagucaccuggugugagugcuggagauggaagggcaagcucuccuaaccgcugagcugucccucuguagugucuuguuuucauguucagcagugggaccuuucucuucuuuucuuuuuuuuuuuuuuuuuuuguuugcuuguuuguuuguuuugagacaggguuucucuguauaacccuggauguccuggaacucacuuuguagaccaggcuggccuugaacucagaaauccuccugccucugccucccaagugcugggauuaaaggugugcgucaccacugccuggcgugggauuccuuuuuaaacagccuuucuuguugaugucacggaauccuagaaggcugcuuuucuucugacgugucccuccguacauguaauuuaucuugaucacagucacugccacuaucugccuucagcucccucccccuccccaucaccuuuuccuuuguaauccaccuuugugucuucuuuuauucuccuuaguaaauucacuuuuauugauaagacccuauuuuucugagagcaaaauagccauuggccacauucaauaaagaaaucccgggacuggugagauagcucagugguuaagagcacuggaugcuuuucuagaggucucagauuaaauucccaguacccacauggugccuuacaaccaucuguaacugcaguuuccuggaacacaaugccuucugccauuuaccggcacugcaguguauguuaugcacagguacuaacaucuaaacacauaagaaugaauaaaugaguaauugagaaaggaaaucuugagcuaaacagaauaccagagacuguuaacagacuguaauaaacucagaucaugccuucugagaccaaguccugagagaugcaguuugacuguacacaggauuagaguucccuuuauaaaguagcacauuuugauggucuacaagaaaggaagacagaaaaaaaauggagaugaaguaagaggaaaagaagagaauagaauuuggguaucagcucccauagcagugaaacgagaaaaagagaccacacgugaugggguccaacuuuagcuucccacauagaaugcccucccaguaauucucugguccucccuccauucccuaaacucccucuuccucucagccuccaccugcugcucuuacugucaggugcagccuccaagcauugggcugcucuucccagccugcaucugccuguacgcucagugccagcgcagggaguagaagcccagucaguaugcugggguggaucugucacaguacugaagaccuuuccuguuucucugcuuuuccauugauuuagcagggcuagggugugaauauguuuaugaguucccguguccagugcagaauucuucuccuuugugcuuucuggauuugccgucauguuucaucgcuucccacucuggggcauacugcuuuacauuucuccaaauuuguucuaacacaccuuggguuuguuuuuuaaacauuugaauauuacucaauuuguuguauaucuugguauaagauacuagguagggaugugaauuaauuuuuucccaacaaguaccuauucuccaaacaaucuucccauuucgccauagauguaaaaugugcuuguugaugccaaguuccucugaguuuuguucuguuucccaguugucuuuugagcuaugugugugcagcuuagaccccgacuguuuucuaugacagaacuguccacacaucucuucucccuuagaaugguguugguuaugacugacuuguuuguguuucuacuugaacuugagaauuagcucucauuauuuaaaaaacaucuguaacauaauaauuguaucagaauuuugacagauuugcccucggaaauugauccaucaugccugcugucuguggugucugggauggaaugcaggacuugaugcuugcuauucccagacucuacgaacugagcuacacuccgcagccgugugugugugugugugugugugugugugugugugugugugugugugugugcgugcgugcgugugcgugugcuugcauaugugugcucgaguguuugacugcauuuaucugugaaggccaaagauaucagaucuccugagacuggaguuacaggaaguugucagccaccugauagugguucugguaaccaaauucaggcccuccgcaagaacaguaugugcuugaucacugagcaaacucucaagccccuguuacaagguuuuuaauaugaacgcauguuaauacuuaauaacuuuuccacuuaauuccuuacuauuuaacucccauaggguuuugugcauuuuguuucuuuaagacccaaauuccugggcauuucuucuuuuaaaauuucuuguuugaguuuuaugacuuggccacaaugcuuguucuaggguuaggggagaaauagaaaaugcagaccccagucucacagugacaggucugucaucucacacucacccacacauacagucugaguagugacuguuucuuagucacucucacugccucuguugggcuucucaggguuggccucaguggacagcuuuucaugucucuagugucuguggaucucuuucccugcuggcuucagcugcuuguggcugagagaguggcuacggucauauggcuccaauuggguuccucguuucccuagcgcccccaugucacagccucauucaguuaugaaggguuuggucuuguuguccguguuguccgucguuuuuucaggggguuuauugucucauucuguuugucuguuuguuuguauguuuuguuuuguguuuuacgcuuuuuggaaauaggcauuuucaaacaacuuuuaaauguuucugcaggaaagccuugcuuacaaaguauucacauucuuugagaauugagcauggacuaauucuguuaugcauauuucugaaauugaacauaaauucucuuuuaauuuccuuuauuuuugcuuuuuauuuguaauuuguagguuuuuuguuuuguuuuguuuuugagucaaacaucagaucaagcuaauugcuuccauucuguuuuucagccuggcuggguuguuuuggaccaaccagaugcugccacucauuugccgcauccaccagaacccucuccccuaccuccaggaugggaagagaggcaggauguccuuggaaggaccuacuacguaaaccaugaaucuagaagaacacaguggaaaaggccaagcccugaguaugugccagucugcauagauuuugcugcuccuuggccuguuaaugcugugauucgaguaggcguauagugguauagggaccccugaacugucagcuaaccaccauugaaaaacuuaguuagcugugauuuuuaaaaaaugauuugauauuguuuaaaaaauauuuggaggccagcaagauggcuugguguaugaaggacccuugcuacccagccugauccccaggucccacauaguagaaggagagaagugauuaccaaaagcuaucuucugaccaccacaugugugucaugccaugcucacaucuauauacacacauguaauaaaaaacaaagcauaucuugaaaaacaauuuuaggcuagagcuguggcucacuugccuacaggagacccugaguuccgucuccagcaucacauaagacgacauacgguggcgauccucuaaucccugcacuugaagguagaggcaggaucgcaaguucaagguuauucuuaacuuucugcaguguuuuugugcugcuagaguuuggagccagugccucauuccugcuaaacaaguucuuucccacugaaccacaacccagcacuucauuuuuaaaauagaaauuauuguuaauucacagugaagacacuaauggguccuuuccuaacacccuucucuaauuuagaugguagacauagaucuucccacaugcagaugcaaggcagaauaaccuuggauauguucaugcucauagcuccuuaguggcuuuuuuuuuuuuuuaaguauaaaacugcacugugaucucauuuggaguuagagguuuaauucacuaggaaagugcuuggcuagcaagcuuaaggccccuaguucaaucuccaggacgaaaacagaugaggaaacuaacaacaauugugcauguuauucccagaaucagauauccuccugucuuccuucuccuguagccucacguggcuguuuucaaucuuugagugcuugacacauccuuaucauuuaucuuacuaguccauucaccuccaauacaucugauacuuccuaaaaauuuuuuccugucuguuuucaaacccuccaaaguagacuaguggucacacucucaagcacauggccaucaggaucugcgcgaucacacaccaaguacaaagugggacagucugucaagcuacccuguugucuuugacagacaggcagaccugccacacagaaucguguguucuacugguggugucgauuucagguggcaggaugcagaugcaagaaaaaaaauuaaacauuucuuagauccauuagucacaauuuauguuuuuacaagccacaauagagaaugauuuucuuguggcugggggguacgggaggugaugcuguggacaguuugauauaguucucauguucugugaaccgguaagguaucugugguugguaaugcuguauugaauguuuguaaaagcaaacgaggaugucacccagaagugauaugaauaagugauauguacgucaagcacucccaucucuuuauacacagucacuaacagugugugcacccauggaccacauagcaccccaaccuguccaauguccugcuuuuguuuuuaauuuuuacuuuauuuuguauguauggcuguuuugccuauauguauaucugugcaaaagacaguauaagagcuccuggaacuuuuggguuuuugguuuuucgauaugggcuuacucuguauagcccugguuguucuggaacuagcucuguagaccaggcuggccucaaacucaaagagaucugccugccucugccuccuaauugguguaauuaaagguguaucucauccacuauggcaaaaauuauauuuuaaaagaacugauuuuaaaaauggaaauaguuuaggaucguuuagaaacuaucuuggucuaauaugacaucaaacaaaugaauauuuugggggccauuaagauggcucagugagcuugauuccccugaaccaacaagauaaaaagagagaccuaauuccugcaaguagguuucuggccuccacacucaugcccagggcacacacauguauaaacaccuaacacauaaauacuuaaaaaauuuuaaguuaagauuuuuguucccgauuguaugaauaaaauuccugauuugucucaauauagacagaaauaacuaggcuauuguaaccuagacaugccuaaaguuugugcuuuuccuggacuuagaucucuauuaaauuuucagccguagggugcuuguacugccugccauuccucuucugcaugccugcauggggaguauggcucccugcuaagaccgagcccaccaguuaauccauucaugaggcauccuguuacuuuagaacugccuuggguuucuaucucaggcugacaugguacaagaauaauaaacaaauuucaugucaaacaucauuugugccguuaguuuucucagcugguaagaggaacuguaguugaggacuugucuucauaugugccuguggacauguccgaugggcauuuucuagguugaucauuaaugugagaggguacaacauacuguuggcaguggcaacccugggcaagugguccuggguuguaugaggaccagauucuugcccuuggugaugacuggagccuguaaaagaaaaucgccuuuuccuuccuggguugcucuuggucaggguuuuaucauagcauaagaaucaagcuagcacagugaugaacuaaauaucagcucuuaacacauuugcaugagauuucuacuuccaauguacauuuucuucugcccuaguuucccagaccaaaguguugacagugugauuagcuuuggucagaacccaugaauucaaucuagggaugaguaagcacagacucuuugauuaugauucuaacuguaacaaggcaggggugacgccuucuuacacuucugcccuagcgaugaccucacggaugaagacaaugaugauaugcagcugcaagcgcagcgagcauucaccaccaggcggcagauaucggaggauguggauggcccugacaaccgggaguccccugagguaugaacccuuccuucucuuguucccguguccggcacauguuaugcaguggaugaguguggacucugcucuuuucagaauugggaaaucguacgagaagaugaaaacaccgaguauaguggucaggcuguccagucaccuccaucgggucacauugaugugcagacucaccuugcagaagaguuuaauaccagacuugcuguguguggaaauccagccaccagccagccgguuaccagcucaguaagaugauuuagaucuugucaugaauuugugauaccuugucauacauugauguaacagcguauguuuuauguagacuuuugucuucagugacaugccauaguaacauguugggggcuuucacuuacccuuccacuaacuccguggagcagagcguggauaguucuaauggacccuguguucucggguccuucacccacugccaccagaaacacggaagccacaagcugugguucuuggucguuucacacaaagaaucauggacuggcagugagagggugccagcgaggacgguggauuugauuccuuggggaauuuuaaaagagguugggggagacaggagacuacucuagauguugucaggaaguggaaagaauuguguuugaauaacucagaucuccuccugugaggacacaacucgaugaggagaaagaagaguggacaugacaacuguuugguauuuugcagcuuagguaguggguuuguuucauuuuguuucuugguuuuguuuuuuguuuguuguuguuuuuccuauguucagacacaauuuagacggcaacuugaauuugccaugacucugucugugugugccagguuaguucaugagugguggaaacuacuucucuaucuugguugugugaguugacauuguuuuuugggguggguguuuuuuguuuuguuuuuuaaagauuuuguguguguguguguguguugacugcauguauguguaacaugucuaugcuugauacccucaaaggcccaaaguaacugacagauccccagcaacuagaguuagagacaguugugaacuacaaugugggugcugggaauugaacccugguucugcuuuuacgcacuugaacuguaucucuauucccuguaugagguuuuaacauaaaaucacagaugucacccauccguacacauguguagauuagaggcauauugguuaaaugaggagagaaguaaugguuucauucacugucuacaggguccacaaacaagcaccccagcaugcaucuaccaccccugugggagccucuggcuggccagguacaaggugccauaaccacucacucacugagacuucaucuguccuaaaguggacagaacaccuugaucuucaggacuucauucuagugcagggucauuacugcgcccugcgugccaaaucugcagcugccuguugccauaaauaaggugucaauggaauccagccauuccuacuuguucauggccauguucaaaccacaucucagagccaagcaauuagaacuagcauucaguguugcaccucagcggguaauuauuugcuaaguucuagcuccuuccucaagaaguuucaccuaugggcuggugagauggcucagcugguaagagcaccgacugcucuuccgaagguccugaguucaaaucccagcaaccacaugguggcucacaaccacccauaaugagaucugaugcccucuucugaugcaucugaaaacagcuacaguguacuuauguauaauaauaaauaaaucucuuaaaaaaaaaaaaaaaagaaguucuacauaguuguaugucccuaccuacgugaguauccgucagguugccucuucaccggccuccuuuucuuucuuucuuccacagccuauucuuuuuuccauuugcuuaaucaauuaauuugucaggggucaaaggaaaggauucaucagauuuacagaauagguauggggagaugacucagaaaaguauuugccaugcagauaaaagucccugaguauaaugcccagaacccauguaaaauaaaaaccagaugcagcagugugcccaugucaugcuuaggccuucuaugaguuaccgucaccuguuaagaauauucuugaaccauuucaugaauguguugaaaccugagacaguauugaggcuuacaaaguaaaaaaugguucuuccuucuuccuuccgaauuacauugccucagugacuacuaaugguuuuaaauguagugucuuaaacauuacauauuuauucauaaacauacauguaugcacauauaguuacauaccuuuaaaguuuuuuauagaagauuuauuuuaauguguaugugugcauguuuauauguaucuguauauggguuugugcacauggacacaugaguguagugcccauggaguccagaagagaggacaucaaaucccuugaagcuggaguuacagguaguugugagccaccugauaggugcugauuccaagauauguaccucuggaagagcagcaagcccucuuaacugcugagccauuuuuacaaccccuauauguaauuuuaaagagugugugugugucuaucugucugucugucugucugucugucugucugugugucugugucuguguguguugcuguucuguguuuuuguggguugguugauuuggggugugaggaucaaauagcuuuaugugugcagagcgugugucucaucuccaagccacacucuaguucccuguggucaucuuacacaucccuuuugguuauuauuuuucacuugcuaauugaacuguuuccauggauaucaauguacuucuuuuaaaaucacuaaaacuaguuguccugaaaauauccaccauuuccuguugugaugaacuuauguuguuuaaucauuuguguuaucauaaacaguacaguuugggauauucugauuuuauguauguguauuuguaaguuuugaugccauuuaauaacaaaaauaagauauuucaguuagugguuaaugaucacggugaaggggaagagagaauggauuuccaggaaauaaguuaucagaguggacacccaguggugggcugugaguccagaagugucgagaugaggaagggccagguucugagcgggagcacaguguuuggugcugaacauccaaguacucgaugaaauuuuguugaagguaguaggcagagaacaagcguguuaaauccagcccucuggcuacagcuggaaaucuggacaugcagaaaugaggguugaagcaggaagcccuugucacugucagaguaauuaaggugacaaauggugaaauuguuuuauuugggucuagcaagaaaagccauguuugaacuugcuaggaaugacagugugaaggaaugaguuagaguggguauccgcagggaaaauccaaguccagucgugucuacaacuacauuggaggaccagaagguggaagagccaggguggagggcggggagagaaggcaucccccguuuuagccaccccacccuccuggcaugcuugcugucuccuacagugucaacuguacccucccuacauugccugugcucugagugcaaagcuaaaguguuacuuguuuccuccccuuaagaaucauuccagcagaggaggcagcuugcagaccuguaucuuugaggaacagccuacacuuccuguggugaguuuucuccucugccucagccaagaaugaaagaaagauucaaaaccucagcuaauuuuuuugauacuuguauaucacaacacugagugugugacugcuuagcaagggacuagggagacauggggcacaaccuuggaagucaagccucaagagaacugucucucuuguaaagcaagccccgugcucaugugaugguggcaggugggauguggcuucucagcugggacccugcugcucagaggugaugggccgcugcuaccccacaugugauacacagcaugcagcuguguacugacaugcgccacacagccauaucugcccuuuguguggguugucuacccagugcccucuaucauuugguccaguauguggcagccaggucggcauuuucaucucccagcgucucccuuggcagugcucugauucagcacagaccgcccaucuccacagugcuucucaccucuucuuccuggcuuuccucucguuaugccaaggucucacuaccucauguaaucacuuuacuuugcuugugagucgaccucauaucucccaacccuucgaugcccguucuuccucgugcuagaauuacaggcaucgugcaccaugcuugauuuacaaagcucugaggcucccgugucuucguucuacccuuucccuugccugcuacccgccaccuuggcuccugucuguucucuuccaaacaccugaauauccuccuuuuaauucucuauugacucaucugauaugugcacaucccauuacuccucuuggaagucccuccucacuugcccccuggucaguacaccuuuaacugccauucuauauaucaguuuugaggaaagagauggggggccgaggcucaggagagugucuuaucugucuuagaaaaggauucuuuccaguccugugcugaguucaccugacucugaagaccacuggccuagucaucaugacaguagaucguaggggucaagaagggacuccccuguuaucuuguuccgguguccauacccuggcuugucuggccuccuuuuagaccacagcaugugcaagcaaaagccgaaucucacuacaguccuggagcucacuugguagaucaggcuggccucagacucacagauccaccuuccucugccgcccagcaccaagugaauugcuauguuuuaaaaauauguuuuaaaauaugauuuaaaaugugguucauuguucuaaauuuuaaaacaagaguuguuucagagcaccagcagugaagaaaggcaggaggcuucugucagaaauuccuccugguuaacacugagggguuuuuuugugucugugcauauuagcuuuugccuacuucaucuggauugccaccagguugggaagaaaaacaagaugacagaggaagaucauacuauguagaccacaacucuaaaaccaccacaugguccaagcccaccaugcagguacucugaacucuuagcuugucuuugguaagcucagaccucacacuucuagagcaagagcagagugaugaccugcuccuucagugauuguguuguuuaguuuuggcaugcaugccucugugugugugugugugugugugugugugugcgugugcgugugugugugcgugugugugugugcgcgcacgcgugugugugugugugugugugugugcgugcgcacauguauguguauguacaaguggguauguacacgugugggguuguguggggggugcguaugaaagacucauguggaagccuagaguugacacugugaauuccucaauugcucuucauguuauuauguauuuagucagggacuuuggcugaauuuggaguuuucucuaggauuuggucucuagcucucaggcagugggaccauagacuggccgccaugccugaguggcuuucugugugugugcugucgaucuguacugugcucuuuacacuaaugacaagcauuguauccacugagccagcucccugggcacuucuucagauaguuugcuaagcuaaucuugcugacuagugucugugcaagaaguuuauaauuauggggaugaagagucggcucaguguuugcugcuuuugcagaggacacacgugguggcucauucguaacuccagguuuagaggaugcgaugcccuguuucagccucaugggcacugaauacauuugugugcaaccauacacgcagacaaaauacucauucagauuaaauauauaaaacuguaaaagaaguuuaugggccuggagugauagcucagugguuaaaagcacuggcuuccaaagguccugaguucgacucccagcaaccacacaguggcucauaacccucuguaaggggucagauguccucuucuggugugucugaagacauuggcaguauacccacauacaugaaauaaguaaauacaucuuuuaaaaguuuuauaguuguaauguuuauuuuaucaccauuucuuucacugaaauuuuuucuuuucacauuuaauuuuuuauggggauggauaccauaggguguguaugugugugugugagcgggggucagaggacaacuuacaggcguugguccuuccuucugccauguggguucuggggaaucaaacucggguccuuagguguagcaagcaccuuugcccacucagccaucucacuggcccuaaagccacuucugugcugaggcuguucccacugugacucuuacagggcaaagcgagcuuucugcugugggcacuauaaaccucccaaccccuuucaggcuacacaggcugcuacucuggcuucuuggacagauauguucacagcagucaaaucuuacugcguguuaauuagcugagaaaauuguuauaaauuaguugacuaaauuauuauaaaugcaaaguuugauagaaaauuuuauuuaaaauucaggaaaaaagauuuuuuaagagugguuuaagagcaccugcuggucuucccgagaacugaaguugugcccacgucaggaccucugaccuccaugggcccugcaggcaaauccauaugcaggcaugcagggccacauaguaagauuaaauugcuacaaauuagccucagagguuuaagacuugcuugcaagugugccuucuguuuauagguuaagcuagcuauuuuaauucuauuauuugugaguucuccauagauguaaaguaugacguaauucaugugccaggccacauuggagauagucagcugccaucgagccagaguuccgcaggcccucagccagagcuccucaccagggacccugcuaaacaggcaaauccgcauucuaacacugagcaaagauuccuuucugaagguuggggagucuggcaugcaccaaucaaaggccuuucuuuauugaccacaacacccaagacugccaccuggguagcuuccuuccauacuccucacuuuaaauuuauagcagcaauugcuucucaauguagucacaugugcugguauaaucugccuuucuuucuuucuuuuuuuuuuuuuaagauuuauuuauuuauuauauguaaguacacuguagcugucuucagauacuccagaagagggagucagaucucauuauggaugguugugagaugguugugagccaccaugugguugcugggauuugaacuccagaccuucggaagagcagucgggugaucuuacccacugagccaccucaccagcccguaaucugccuuucauaagaaugaauuacaaguaaaaaucuugggguuuagauuuuguuuugguuuuuuuugguuauuugagguaaggucuuauguagcucagacuguucuagaacuugcuguauaacugaagcugaacuugaauuccugauuugccugcuuccaccuccuagguaccacacagaggcccuguuucuguggugcuaggauuuauuuuuauuuuauauacauugguguuuugccugcguguauguauaucuguuugaagaugucagaucacguggagguggauuacagauugaacuugcauccucuggccgagcagcgccaaucuuaaccacugagccaucucucuagcccuggaagccagggcuuuaugcaugcuaggcaagugcuuuccaauugagccaccucuccagcucuagggaaucuuaauauuauuuuauucaagguacauuuaugcuucuuuugacuuagauuagauuuuaugaagguguuccauuuucuaguuuuugguucacucgucuuaaaaacuuaggaagacuuuuaguaauaauuuucuaccucuauaugagacuuacuauuuucagagaacuuucaaguuucuaucucauuuauuaauacucccagaaagacucugugaagcuaagaugaacagauauuuauugcuauuauuguuguuuucagaauuuauuuacauuauuuugcauguaugacuaccuacauauguguccauggaggccagaagaggugucaacacuuaagacuuaagaacuauuuuaaggggcuggugagauggcuuagggguuaagagcgccgacugcucuuccaaagguccugaguucaaaucccagcaaccacaugguggcucacaaccaucuguaaggaaaucagaugccucuucuggagugucugaagacagcaacaguguacuuacauauaguagauaaauauuaaaaaacaaacaaacaaacaaacaaacaaaaaaagaacuauuuuaaaagcuauuucaaagguuugaauagcuaaaacaaaucuaaaagaguuuaauaacuuaguauaauaauauuaagguaauuauacuuuaacuaauccacauaaacugaacuugguucucuuuuuuuaagauucaaauagaucuuaguaaccuuuuuuagucuacccuucuuucaaagaaagaaaaucaauauucagauaggaccacaauaugugauucugcuuguuuauucauucauuuguuugaucacacccaugcaguuauuuauccuguaugugcacaugcaugugcacagcaucuguguggagaucaggggacaguuaacuuguaggggccuguucuauacuucuguucugucaugugagucccagguaucacacucagauuaucagaccugguaguaagcauuuagcccccugagccaccucaccagcccagaugugguccagucuaaugccaccaucuuauaccaguuucugugcagagaaaaacuugauguaguuuggguuccaauggacugggcagaauguucucagaggcuucgcagucggcugaaaugggucucaguggaagacaucacuccugagcccacuggggaguggcguucucacccaucaguaggaccucccagcaguaucuuccagaaguagaaauaagucacaaggaaaggaauuaaagaugaaguacagugagguggcacagccccuagcccuaccacucaagaggcugugcgguaggaacacgggaacuccagcgccagucugggcugugagcucuugucucaaaaagccaaaccaucgguguaaaugaaguauaaaagagaauuuuauuuauuucauuauuuuuucauuuucaugugugugugugugugugugugugugugugugugcuacacauguacauugccugccauccaaggcuagaauuagaguggaccauggugccugccugguguuugcuuauucuuagaauccaggcuucuguccucacuguugcauggcaaaugcuuuaacuacugagcugcuucuacagcuccaaagaguauuuuaaaaucuauuggcauuacaaagcaacuguagcacaaugacuggcauuauuuuaaaauguguaugucguuuuauuuaugacuaaaacaaauaaaggaugauccaagaucgaaaaucccugcucaucugagaggaaagacugacuccaaugaccugggacccuuaccuguaaguucuccugcugagcucacuucacuauuucagacauuuuguaccuugggaugcuggaguuacuuaacaacuauaacuaacauuguuaauaaguuauugaugccuuucguuuuaaguguuauguacaaauuaagcauauaugcaauaugagaucuucuauuucuguuucuuuuuuuuuuuuuuuuaaauaaccuguacaucuaagaccugguacuaaaauaauugcaaugaauguuuccuuacagccaggcugggaagaaagaacccacacagaugggcgagucuucuucauaaaccacaguacgugcugcauggcuucucucuggcaguuguuuguaguacucagguguggacaugaggaagaggaacagcucuuuucuuuucuuuuuuuucccucuuagauauaaagaagacccagugggaagauccucgccugcagaacguggcaaucacuggaccagugaguucuggaaucuggugcucugggucggggugaaacuagaggaacacccuccuccggccucucuuuucuuugaaaagauagugugaaagccuuuuuacccugcuccucaggcuuggacagccagaagcagucagggcugggcgcugugggggcuggggcaguagacugcccaguccaggcaggcuaaaguaacacacaaggcaucaggagcccggcuggggcggggugaguggcaccucccuuucaucuccaggaucacaccuugaacuagauuuuuagucaaagccauugcaaaaugccuacuauuuaagccuuauucauguuuuguauaaauauuucagugucccauaauuaugcugaucuugaguuagguuaauuuauaggaaacucugccauauagcuacuuguuuuuguuuuuguuuuuuguuuuucugaaacaggguuucucuguauagcccuggcuguccuagaacucacuuuguagaccaggcugucucaaacucagaaauccaccugccucugccucugccucccaagugcugggauuaaaguuguucaccaccacugcccagccuacuuuuuuuuuuuccuucagauuuuaauacacaaaauuaaucaaaauuggauauacagguuuuuggguuuuguuuuguuuuuuuaguaucuagcauguuaguguguacucuuuaaaugauaaguaaguaagggaacuccugggaguccaugggaaacaauguauuuuucaauguuuccuuuaacggagaaggcauuuuuuucagaaguagcaugagcugcgaauaguggcacauuguguuaacaacauaagucaaguacguugauugcugugacuucaaggcuagccuggucuacauagagaauucacagauagccagugauacauagagacucucuuuacaaaaggaaagaaaagcagccgcagagacugcugaaugcuauuuuacuuuuaagagaaauuuuuuaaaaauuaaguuuucuguuugcuuuucuucauaugaaacuucaauuuccaaguaauucuuuguuguuguaaauacucauuaaaauauccagggggagaauauaauguuguuuggaauaaaaacgaccuaaacuuccuucauuuuuuuuuuuuucaaauguuuucaacuaaaggcagugcccuacuccagagauuacaagagaaaguacgaguucuucagaaggaagcucaagaagcaggugggugacgucauaacagcugcucacagaaaaugguggugugugugugugugagugugugugugugugugugagugugugugcguguguguguguguguguuaaauuauuuucagagacccauuuauucagccuguaugaguguucuuccucaugcauaccuggucuggugcuuguggaagcaggagagggggcugggucugcagcugcaguuccaggaugguuaagcuguccugcgggccugaaucuggguccugugcaagaguagggagaucucugagccacugagccaccucuucagcuccaugauuuuuaaaagauuauuacuuuuaaaggcuggacauggugaugcaugccauuaaucccagcacucggaaggcagaggucggugccucuccaugagcucaggaacaaucaaggauguguagugacaccuuucaaaaaacaaaacaaaaggaacuacaaguuuaauugugugugagugcuguagcugccaaggugucauguccgcugucccuauaggugguugugagcugcuugccaugaacccugugagcugagcucaggucccuuacgugagcagugcgugcucuuaccugcugagccaccucucuaacccugggaugcguguauuucagauaacuuauaaguagcaugcuuacauuccuguguacuuuucaggagucuuuguaauuuagaaaaagaucaugggggcuagagagauggcucagcaguuaagagcacugacugcucuuccagagguccugaguucaauucccagcaaccacaugguggcucacaaccaucuguaaugggaucugaugcccucuucugguuugucugaagacaguggcaauauacuccuauacauuaaauaaauaaauaggaaaggaaaaaagaaaaaggucauaacacaguugcuguagucucucuccuccuguuuuuguucuuuguaacuuggugaucaggagauuuucuuucuugguguuuuauguuugauuguguuccaggcuucuggacccuugacuaccuuagguguuaauagccaucuauucucagcuuuaagcacaauacaugucaacacaauuuaaaaguuaacaguguggcuggagagauggcucagaccacugacuacucuuccagaaguccuaaguucaauucccagcaaccaccugguggcucacaaccaucuguaaugagaucuggugcccucuucugacaugcaggcagagcacuguauacaauaaauaaauaaauaaauaaauaaauaaauaaauaaauaaaucuuuuuuuaaaaaaaaguuagcugugaacacagugcagauguaugguauuguuacucauuuccuuaugcuuggcagauacguuuguuacucuuucccaugaccaaacuucauuauguuuauuauuaaaugcccaucauuugguauaacuagcauuuuaaaugccuuccucguggaauggucccuuccuccuuucccugcaguuuaggggcgaggccacuagguggcaguacuaguugugcuuuuuugagggguuccaagcuggugacuuccagggauucaaaaugguggguuagauaccagaguuuuucauuuacaaauuuaacaaaaugaaacacuacuuuuuuauuuuuaguguacauauuauauuccccaauaaaauuuuuacauagaaaaggccuuuuaaauucuucagaacuuuuuccuuaaacaauaacuuuguguauaaauuucuauuuuuaggcauugugauuuuaaagcauuugaugagggauauggguagauugaccucuucaguucgaggccugccuggucuucauagaguuccaggacaaggguuucacagagagacucgaucucaaguuaaaaaaaaaaaaaaaccacaagcuuuuuaaaauaagggagcuugggccugguugugcacaccuuuaaucccagcacucaggaggcagaggcaggcggauuucugaguucgaagccagccuggucuacaaagugaguuccaggacagucagggcuauacagagaaacccugucucaaaaaaaaaaaaaaaaaaaaagaaaucauaccacuuccacacuggauauggggaugcauaacaauaaguccagacuggguggguugggagugggcuuugaggguuucuaggcuacccggagcaagugaauggcaauccuggaugacaaaaauggacccuguuucuuaaagcaggguggggaaagaaaguucaguacaccuaagugggguuguccugguggccuuacuuaaagggaaaggguaucggugccuggugaagugugggaaacacacugggcuauuuuaaacaugucucucucccuggcucugcagacugacauuccaaacaaauuugaaaugaagcuucgccgcgcaaacauucuggaggauucuuaccggaggauuaugggugugaagagagcugacuugcucaaggccagacucuggauugaguuugauggugaaaagggccuugacuauggagggguugccagagagugguucuuccucaucucgaaggaaauguucaacccuuacuacggccuguuugaauauucugcuacguaaguuccugcugccucagccuccucauuugcuaagacucagccacacguccuuacacuguucauaaauacuuuaaauggcugugcacuaaauuauagucuccaaaacuagguuacauguuagaaagcaugggcuacgugaucggggccacaaggagauauuucagaaauagcuuuuuaaagauuguuuuauaggaccugaaaauuguauauaauguacauagaaauuaccauuuuaaccuuguguguguguuguggauugcacgugguaggcaggccguccuccacagaaugcccaccucacagaccucuguaagcacacacuuggcuggcguuucaagugcuuccuguauuguugaucucuguaccuuucccauccuccugaauaauucuacauucauuaaacacuuuucccaccauauacaggcagccaccagucugcuauucucugugccucugacuacauccauacauuagaugcaugggaccauacagcacugggcugaaguguauggauuaugucacuuaacauaugucaagugacauuuccuuggaaaacaugaacaaaccucucuuaccaaagauaggguaccaagaacagaccaaccuuuuauucuuaccaaagcccaacauggaaaaccaaugggcuaacuugaagaacuuuugagacaugugggugagggacucuucuggcaucaggcaugacucuugggcagcagagaagcccuuccuagcaugggugaggcccuacaaaggcugugucccuggagcucccugcaugaccacaggagcucuguuggucagagucucuucuccccugcugcugcuuuaccucacccaggggaguggcuuuguagaucuuuuacguuuucauaacuuccuggaucuuuguuuuuaguuucauuuaaugugaauaguuuuucaccugcauguaugccugugcaccauacgcauguaguacccucagaggccacaagggggcaacggaacugauguuccagaugguuguuaguugccaugugggugcuggaaauucaacugcagguaggucuucuacaacagcagcaggugcucuuccugggucuugugagccucugugucuuuccaggggcaguauuugaauucaauucagagaaauuguccaacaaccugucuuuaaagucuagccaugguauuccaagcagaaagguuuuuuucuuuauccuuuguauauacaaauaaaauaguuuuuaaucuaucuguuuacguguccuuugggacuauuuccaucuuuggacagaagugacuauuuaagaccauuaucagauccagugauuuuagcacaggaaaauaacaaaaggggagauuuucauaaucguuuauuuacauaaauuauuuuguucuaugaacuauugagagggucacaugagucugguuugucuuuccagggauaauuacacccuacagauaaauccuaacucgggcuuguguaaugaagaucaccucucauacuucaaguucauuggccguguggcugggauggcaguuuaucauggcaagcuguuggaugguuagcaucauguugcaaucuuuauguguuuauuguuguuguuuuugauuuuaaaaaaucuuaaaaauacuuuauuucuuacaaggguuuuucauccguccguuuuacaagaugaugcuucagaaacugauaacacugcacgacauggaguccgugguaggucucuuaugcguuagaauacggaggguucagugggcagaugauuucuugcagaauuggcuuaauggugguggcaccugcuuagugagugcuguaccucuaaguggcauacauaacccagauaauuuauauuaaaaacagaaauucauaaauuuuaauguguuaaaauauagauaggggcuaaggagaugggccaguggguaggagcauuugcugggcaccaaaaaaagcacaggggccggaguuuacauccuuucaccacagaaaaaguugguugugucugcuugagugucugaaaccucagcacuguuggggauggaagcuggaggauuucugggcuuugcuaccuacccaugagcucaguuucagggucagcgagaagccccaucucagugagacaacacagagggugacugagcagggcccgugugcccagugggugcaugcgcccacuacacacauaugcaggcacagucaucugcauacagaaauaugcagaugaacauuuccccucauagaauacauugaagggacuucgcagugaguacuugcaucucuacugucuacugcacugacuucauucuugcgccucuguccaucaguccaucuguuucucaggcacuguaacuauuaaucacaucuucugcugcaaccuuuuaaauuuacauagcuuguuuguguaugcauguaggcaccacauaaagagggagccaguuccauuguguagauuccaggauugauucugcucauuaaguggcaccugccuuuaaccacugagcccucuccguacacauuuuaauuagauuuauuaaauuuacauguaauuauuuuuauuacauuuguuuaguggggaagggaguguugcuuauaaguggcacacccgugaacgucaacagacacuuggccguaguugcuucucuccuucuguccugugggucucagugaugaacucagacuaccaugcuccgugacaguugccuuuacccacugaggagucuugcaagaccugcuagguucuuuaugccacauaguaguuagauaaucuuuugcaucacguuuugcgauauaguuacuuacaaugaauggcaaauguuuaaagccgucacuacaaaggcagaguguuggggcaggguuccuguaagcgaacagaagcccaaggaccaaguccuguguguggcucugugcaguguagauacacauggucaguuacaaacacuaugauuuuuauguuauguguaugaguguguguaugugcaccauauacacgccuggugcgcuuagaggccagaaagagaugcuguguccccuuaagcuggagcagcagaugguugugagcugugauguggccgcuuggaauuaaaccuuguucuucugcaaaagcaaccagagcuuuuacccgcugagcggcuagcucucuaggccccgauugauucuugugcuuuuucuuguuacuugagaccgugucuuacggagaacagacuggccucaacacacuauguagccagcgaugacuucugacccuccugccuccucuuaugggugcugugguuacagcuacaccaccacaccugguucgugcuuuucuaggaaucaaccccagggcuuuacacaggcuaguaagugcuccaccaguuuagugagccgcauccccagcaggagucuuuggauauuguaagagcacagggcuauuauuuggguugguuaaaagauaacauacuuaauuugaaacuuuugaguaccgggcagcagugaacucugacauuccacauggacucaucucacaguccuggugcugggagcugaggugugugcccugcgcccggcauuuccucgguuaugguggagaugcagacucagacccucauacuugugaggcgcacgcucugcugccugagcgucucccagcccgucaguguacuugucgugccuguugagguaucuuucuguauacagauuuuuuaagugaguuuuuccuuagggcuguagcucagugguaaagcacaugccuagaauauacaauucuaggcugaguucaauuccuagcacugcaaaauuaauugauuaauuaauuggaguguaauuuuccuucuaggauagugaauauuacaguucucugcgauggauucuugaaaaugacccgacggagcuggaccugagauuuaucauagaugaagaacuuuuuggacaggucuguggacuuucagauacuaaacauccuuugcaaaaccaauccugucaccuaauuauaggcgucaguacacccuugagacacuuuugggcucagcuuauacauucauucucuggaagcaaaagcugucucucagccagcauuuguaucugugcugacacaugaccacuucuguguuugucugaguagaacuuauguuuaagguuucuuagcuuuucacuuuugaguggauuuaauuuaaaacaccaggcuucugguguaauucaugugcgcuuuucucccauuucccuuacaaaaaccacauucauguuuacuuuagacacaucagcacgaacugaaaaccggaggaucagagauuguugucaccaauaagaacaaaaaggaguauaucuagugaguacuuaauuucuaaauauuuucuagaaauaaucccaugcugcuuuuuucuguuccuucuccuccucuuuucuucuuugagaagauuuuuccuuuccuuguucuuucuucccccgugccagaaucucaguucucuuaggacaagcacacccuaguucuccccgauucugcucagcuuuugccuugggcccagcuccagucucucuguuucuuuuuuuuuuugguuuuucgauacaggguuucucuguauagucuuggcuguccuggaacucacuuuguauaccaggcuggccucaaacucagaaauccgccugccucugccucccgagugcugggauuaaaggcaugcgccaccaugcccggcugucuguuucuuuuuuguuguuguuuuuuucaagacaggguuucucuguguagcccuggcuguccuggaaaucacuuuguauaccaggcuggccuugaacucagaaaucugccugccucugccucccaagugcugggauuaaaggcgugcaccaccaugcccggccagucugucuguuucuaagugguauaaacauguccuaaaauuguuucuugguuuguauugggggggaaauggaaagaaauguuuuguuuuguuuuuccuccuuuuagccuuguaauacaauggcgauuugugaaccguauccagaagcaaauggcagcuuuuaaagagguagguacacagcacucuugcucaccauacccagacuuccaagacccacacaucugagaggguaagauguggugggcucuguaaagucuuucucaauauguuucuaguuugauuuuauguuuuuaaaauaauauacauaugcacucauggagaucaguaaagaacccccuggaguguacaaguugggucccaauucuuucuucuagucccaugcucccagaaauaagacucagacccaagucuuacaaguacccuggccauauagcuagguucuucucugacuaggaucauaacuuauagauaacacauuuauuucaaucuuuauucugccauguagcugguuaccucugcucaggugcuauaugucagucucacuauauauuccugggcaaaucuuccugcucugacugucuucaagaauucuuagaaucuuagugggaagugguuagggaggcucaaagcgggauuaagcuggggacuagaggaacucagagaaaaagccaugagcaagcagcugugccagugagaacgagagucuucaguccuccaagugggggaaaguaaggugcagaggugcuaugguugggggcggaggccggaugaaugcaaguccaagggcagccugggauacauaguaugacccugucaaaaagggaguagggagagagauuguaguauuaagagcaggcugggagggcucaguggguuuaaggugugugcugccaaacuugaggacauggcuuugaacccugggcacauauaaucacuuaguggaaggagaaagcuaacuccugcaagcugucauccgacugccacacacgugcuguggaacauguguacccauacauuuacacagacauacaggcacaaacgugauguuuuagacaaaaaucaaauagaauagaaauacaaaguguuuaccagaccguuacagugcugaccuuggcugugucugcagcagggcagguggcagugugguggaggggcaguuggcguacaaaugacugaauuuagcuuugcacacucuguguacuugucugugaaaggaagaagugagaggugacuuugugcaggcuucagugggugaaggagaggagcagggagcugaggacacugcagaagccucugaggccuugcugaggggucuucccuccugcagugggcguggccaggguggggggaggaauuuugucugacucagucuccucaguacugugaacaagggagggagagggacaaaggaggcuguuaccagccacuuuaagaaauaaagaacagccauauugaaaugcaguguguagcggcaaagucuguagaagugaacgcgcuccccuuuaccagacgcuggagcauagcugugccugcucacuagcuuccgacgcguuuccuuuccuucuagggauuuuuugaacugauaccacaggaucucaucaagauauuugaugaaaaugagcuagagguaagaacuauuucugcaugugcuugggaauguaguuaaugagcgcugcaggccaugaguucaguccuuagcaccacuggugugggguagaggggauggccauuuguggaagggaugagggaggggcuuccuuagcgugugaagcccugggccccguccucagacaccguagaacgggugugguggugcacaccuguuacccagcucuuuggagguggaagcaagaagaccaauaguucuugucauccagagcuacacuguuugaagcuaaccugggcuacagggacccugucuuuaaaaagagaacuggagggcugacaagauggcucagugggaaaaguagaccgccaagccugacagccugaauuuggcuccuggaguggacauggacccccaaugaguuguccucuaacuuucucacucagaacaugacauacacaugcugauguugccauacauacauacauacauacauacauacaguuugauagauagauagauagauagauagauagauagauagauagauagauagauagauagauaaggaaagagaaaugcucuaugguuuuguuuuuuuuaagauauauuuuauguauaugagugcacuguugcugucuucagacacagcagaagagggcaucagauuccauuagagaugguugugagccaucaugagauugcugagaauugaacucaggaccucuggaagagcaaucagugcucuuaacagcugagccaucucucuagcccuaaaugcucuauguuaaaacagcuuuggcuggaugucccagcacugagggacagaggcagugaaccgcugugaguuugaggccagccugaucuauauaaugaguuccagagguacauaauaagacccugucucgggaaggagaaaacagcagagcuucgcccugguuuuccugcuuaccauucugacugccgauccguguaucugucugcagcuucucauguguggucugggagauguggaugugaacgacuggcgggaacacacaaaauacaaaaauggcuacagcaugaaccaccaggucauccacugguucuggaagguaaucuaagacauguacucagucgugcuaugccucugagugugaguccacccuugccaauagccauggguaagcagggagagcauucagggugcacugagaugggcacauuagcuuucaccaaugugggaacacucuuagaaugugagguaaccggcaacauggcuccucuaaaugcuuacagcuaugccuuucaguaauaccaauauaugcaacugucaaagguuuuuguuuugggggagggagggagggagagagagaagagagagaaugcuugcauggauuugugucaaugcgugcaauaguuguagaagccaagagggagcaagguuccacuggaagcacaguuacagacgguugugagccaacuguagaugcuggggacugaauccaggccaugcaagagcauucuuaacugcugagccaucucuccauugcugagagaaaagucuuagaaauaggauuuguuugucuuuguuuuuuugagaacaagaacaaacuuuagugauuauucucuaaaugcuaaucacuuuuugaguucucuguacaagacuacacagagaaaccuugucucgaacaaaaucaaaauaaaaaaaaaaaaagaguucucuguauagcuuugacuauccuguauccucuguagaccaugcuggcuuugaacucagagauccacaugccgccaccacugccuccaggggcucuaauggcuuucccagggcaguuuguuauuuucaguacucuugucacucuugucuagcagaagucuuucucuuuuucaggcuguuuggaugauggauucggaaaaaagaauacgcuuacuucaguuugucacuggcacaucccgugugccgaugaauggguuugcugaacucuaugguaaggguccugugcagagcucucagaaguaugcacacaccgacugucauugucauagcucaggcgucuucaggcuuccacuuuaguuuaauuuuuaaacaacuaaguuauaggcuugggagacaacaugaugguaaagugccaaccuagacuaccuggcaaacugcagguagguaagaggcucugucccaaaaagagaaguggaggugcugcuaccuucucauuggacagugacagaaacuggcacaugguugaguuacuuuccgucuugggcauuaagcugcguucucugugcugugguccuagaaacccagcaccuccagcccagcucugccuuuccaagcuuccucacgcugcagcccucugaggcuccuccugucaugcucacucuuuuguugcuacuucauaauuguaauuuugcuacuaucaugagucauaauauaaaugccuauguuuucuaguugucuuaggugaccucuauaauggggucauucaguccccuccagggugaaaacccacagguugagaaccacuacucucacugcuggguggagagagcagggaaauagcguuagcugacaucuaugcagugaguguagagaauacaccuuagaggauucgcagacuacacuaaagaaagguaaauucuccucuuacccaaggauucaccuuccgcuacuucaacuaccacagucauucaguccagaaauauuaaaggcauuuuaauaaacagcagagagcauacuuacaugccuacaugugagaugugcaugcaaagaccagguucaucacuauucacuauuuuaggcguccacaggggacuugaaacauucucuccacagguuaggaagaacucaacaauaucuuaggaacuuguauguaaaaaauaaaguuaaauuaaaaguaaguuuuuccaagcuuuguugauagacaaucuuuuuugugguuuggugugagcuguggaguauagagacucuccgaagggucuuuauucuuuuuucuuuuuugggggcggggguaguuuggguuuuugguuuuuggagacagaguuucucuguguagcgcuggcuguccugaaucucaccucacucuguagaccagucuguccuggaacucagaaauccgccugccucugcuucccaagugcugggauuaaaggcgugcaccaccacugcccagcaggguuuuuauucuuguggaagauggugggaccccagauaagaucacacauagcucccccucuacuuuauuuuauuuuauuuuauuuuauuuuauguuauguuauguguaaugguguuugugcaccgugugcuugccuguggaggccagaagagcaugucagauccccuagugcuacagggaggucgugagccacccaguguggcugcuaggagccuaacuccuguccccugcaagugugggcucuaaacagcugagcucucuccagcccugguacugaaagucguagcugugaucugaucaugaaggacaaauauagaaauuaugccucugagaaacccucuggcagccaugcaugcacauuuggaagugauuaugggauuuaaggagaagaguggaaagaaagucucagaucagguugugagcuugguuaucuggcgcuugggguguugaggauuggagagagcuaaguggaaucucugaaagaaaaaggcgguuucuaaaauguccguaaugagaaaaacuguagacuguguaacagggucacaugcacauaagaugcucuaaacucgcauucucaaccuguggaccgcgacccuaggaggcucacauacuggauauaugcauuacaguguaaaccacuagcaaaauuacaguuacgaaguaucagugaaauaauuguaugguugggggucagcacagcauggcaggcugugaaaggaggggggaagcugcccagaaggacucgggaaucccaggacuugggaaucugaaguacacagguugacaguacuuugaggccagccucagcuauauugugaguuccagcacagccuggacuaagaguaaaacccagucuugaacaucagacaaccaagccuugccgccaagcuugacggccuuaguuaaauccccagggcccacaaguggagagagaacucccacagcuuguugccugaccuccacacauggacacuaagguacagaggaaauaauagugaauaaguauaauuuaaauguuuuaaaagcuaaaagcuuuuacugugguuccguagugcuuucauggcauguaggaggcccuaaauucaacauugaaaaacaaaucaaacaaaagaaaaccccacagaaaccacacaaaacccuucccaggguuaccucaugagcuaagauugucaugacuuucacauccuucagcuguguuuuauucuguuauuuucaguuuuuacagugacauuacauaaucagggaaaaauuaaaacugguccaaugggaaucuaaagcagaaaggaaguccguccucccucccuguaccagugaagaaaguccuaauucaagaugcaacugggucagucuaggaaaaagccgagugucucaggugugccacggugggcagaaagggcucagcgcccucaggugaagggacagacugugcuggacgacucagcagugacuccucacacuggggaggcuucucugucucuucugagucguuuucugugugugcgaguuauauauggagaaguauguuuugaaaugucuacggacuuguggguaaagcaaauuaaaccacagaaacucaucuuccccacaggcucgaauggaccacaauccuucacaguggaacaauggggcaccccugauaagcugccaagagcacacaccuggugaguagcuguuuuacccuagacagggcauaguuucucccugcugguguaggggcagccccagcugugcccucuuguaauagguguguggcagccuuagaagacaggaaggacagaaacucggauccagaaacccauccugcuugggcucaaaauucaggcagcuaaagauagagaugcucugggcuggaggguuugcucagcaguuaaaagcacugacuguuccuguguucaguucccagcaaccacaugguuacucacaaccaucuguaauggaauccaauauucucuucuggugugucugaagacagcuauacucauacauaaaauaaauaaaucuuaaaaaaaauuaggcccaacuaaacuguuggccauauauauaucccuguuccaugaguaauguggucuuuuccccagagugccagaauauucuaucuugauggcuaacauagucaaggaacgcaguuaucuggagagggauguaaggacgagacugcaccagaggucgggagacuucccuggcuguugugaccucuaauagcaaugauggaacaugcucuugaccaaguagcagugggacuaugguuaccauggugacauuuccucccucucugucacucuaaccagauccucucaaucuuuucagcuucaaucgccuggaccugccacccuacgaauccuuugacgaacucugggauaaacuucagauggcaauugagaacacacagggcuuugauggcguugauuagauuacaaaaaaaaacaagcuguggugucuuguacaccauaguuucuaagcaaaagcaaaaacaaaaucacauuuuaacauuuuccagauaguuucuaaaagauggucacuggcucuucccaccgagaccagaggacaguuuauccaugauuuagccaccaccaugcugaccuguucacuuguccaguuacuuuguccaguuguugggguucauguguacggcaggaugugaguccuguacgccugaguucugacccuaucucaucuugcuaggcacauccuucugaaacuacugagauuccaacugugaaauaucuguaaugaguagcuggugggaaaaauuugaugcuuuuuaaagaugaaauuuggacaaagaaagucuuuaaugauuaguauacugcgacauacuuaguaccacaugucgcuacuuauucuguagaccugccuaguguaccuuaucgccuagaaccuugaagccgcuuuggaagauguaucacacguguuuuuagucacuuaagucacuaguguuuaaaaaaaaaauguacucuucacuugggaaguauuucacguuuguuagcaugcagcuugagccuuacaggcgauucuggagacaaguggagcaagcuuuuauugcaguguguagugagucuuaggccuccuuuuugccugugcauccuaaggcuagagucauuauguguuagugcguuagaauuccuucaaacacgaaacaagcuccacaacgcaguguuucuaagcaugccgugaagaaccgaguuccauguaugacuugcccuuaccagccacucuucacgcuugcagucacguaguacauacguguuuacggaguucauuauguuuacagauuaagcgaauuucuguaguugcauuuuuauauuuuuaguaucacguuaguauaaaaauuuguuuaaaauaaccaaagaguaguucaaugcauaauuuguaugaauuuguuaccaaguuucuuaugcuuucuaaaaaaauacuguuuccuaugaaaauuauguuuaaucaaaagucaagaacccuuggggcaaaaugcuacagguggagucccaccauagucaccuuugaggcacaggaagagguuccaugcaugaaucugcacacaugagcagugcuggcugcugugcaccgggcccuugggaugaagccaucagcacugacauccagccccgucuucauccucaggcuuagaaacaagugggauggugacuuuacagucagugggaaguaagagcccgcagaauaacaaaggcagaaggacaggaaagcgagguccgaguccgacugcgaggucauaucugccaaggcuccuucuagucagcuuacacuggugauuauacggaaaaugcucuuagauaugagaaaagcaauguggcauguaaugaguuaguguaagcuuguguuauaaacuuuccgaaugcuuauaaguagccugugggagcuguaagaaauacuuggggccauugauuuaagcuuguuggcucuaacaugacuaauaccugucagcccaugguagggauuucagugacaguaguggaaacgcuuuccacagaccacaccacuauguugaucggugaaagacacccccaggccagugcaugcuuccagaguguccugaucagucagccaggcauggccaccguccaguguugauuuuuaucauuagccagcugagccugcagcacggggcucauuuccccgucuggcagauguggauagcugggcccacucauucugucucucaaggcuaugguaaguucuuaaagggguacuuuucugcaagccaccagagucugagucagcuguccccucccaguaagcauguucaccuaaagugauuuagccuaggcgaggaggaucccuacuacgugcuggauuauguguguguucauguaaggauuucagcgucaaaaguucacuuccuccauaguggcaaaauaacacuaauaugggcugguguguuaucuggagugcccccauuguguggaacuaagggugaaaacagaacuguacacgguuguucagugucguccccagaacucauccccagcagggcuuagaaaacacgagcuuccuuccuccuucacacucauuuuccuuuggaugauucagugacaucacagaaccuggugucccccucccuaccccagguguguaguaaugguccgaagggacccuggcuggaacaccacagccccccaugcuagugcaugaaaacaucucguucauauucuaccacuggggcauuguggagucacauucacgaaacacgaagaccuuguacuucucuagaaaaguguuuuagccuacuuuuucucuaauccccaccccaacaaaugaaacacaaaauugcauuacaaaagcaaacccaaaugguauuuguuuucgauuuuauuuauaccgcucgaguuauuccuuauacguaucaaguuaaacucaauugguuuuaaugauaagcuauuugacauuguuuuuaaauuuuuucuuauaugguaaauguauauccagauuaagguaucgaaauuuauugcauaaacuauaaaaucauuuucaaaaucucaauuccacaaauaaaguucuauucugauuuuaaaaac

SEQ ID NO: 12162 - RNA, 52729 nt, Mus musculus
caaaaaaggccagucgcacggggucccgagcuccauuuggaagggaguaccuaagggauagagcacagcgaggacgcggcacguugggaaucuagcacugcagggacgcaacaccgcagggacagcaccggacagagcaccaaaccgggugagcacucagcguucugggcgcgcugcagauugcaggcgagcaagucagcccuagggcaaccaggggacagaucuucggaauggaugcugguuuucuggaguuccaggggcugaagguuaucccggguggcaucuaggugccaaaaucccuuuaaugaggggaagagaaauaggucugcccaucccucuguccuucccucacuucgguuuuagaagucuuugacuuuaaagucuuuagaguccugcugcuuucaggugagaaagggcucugccuuuuccugucauucagagaacccagcuggucagccuggucuuagagucacccuaucggagguagaauugauggaugacauauuuuggucacuuugccaagaccgggucucuggcccaguagcuggguaccgauuuggaaagccagcucuguaauguaggagaucuugaggcgucucagcagccccccuggccuuugcaucuugcuguugucuggaguauuccccuaggcuucucuuucaagcccaagggcuaacagcuguucugccuuagcuguucagcccagccgggugaggaaggcaggagacauuucguauucuuuaaagcucccuguagaguggaaccgguaugggaaaaguaaucccugcauuuggaagguggacagagaaggauccaggguucaaggucagccuuugcuacauagugugugcuugaaaccagccuggguuacaggagacucuuucucaaaaaacaaacaccaaaaagaaaggaaggggggguauucagaaaugcuaagcgcgccugaaugggagcugccuucuuauuuuaccuuggucuucccccccaccccaacaccuuuccguuuccucuccacagugugucuuauuugucguuguuguuguuguuguuuguuuauuucugacgucaccccgccccacccccucccuugccaccuuuuacgaguuuuuuuggcugugcagaagagucccuuguaucucuguguggaauuuacggucagcuucucaauucuguggccuuggcuuuagagcacgcacaggcauuuugaagagggaagccgccuuugggaaccagacuuuuaacuuccuuuccugauaccuguuuccccaucuuaguaaagaaauuccacucuuagagaaucucaggccaaacaauucucuucauucuuccaugucucuuguccacccugaacacauuuuauugagucuaacuugaguagaacuaaauauuuuuugguuuaaaaacuugguaaguggcuggagaaauggcucugucauuuagagcacagacugcuugcucuuccugaggauccaaguucgguucccagcacccacaacaggcaacucacagcugccuguaacuccaacuucagagaacccagugcugucuucuggacucugccaguauugcacucauugcacaaaaccaaacacacacacacacacacacacuuaaaaauaaacaaacugguaucaaaagauugccuagucggccaucacuggaaagagaugcccauuggacaggcaaacuuuauaugccccaguacaggggaaugccagggccaaaaaaugggaauggguggguaggggagugggggggggggcgggggagagugugggggacuuuugggauagcauuggaaauguaauugaggaaaauacguaauaaaaaaaacaaacuguaaaauugacguucacugaaugcucuggugacuaggaauuauuugcugccuuugcagaggaccuggguuuaguucccagcacccacauggcagcucacuaacacugaguaauuucaguuccaggggacuggauucccuucucuggccacugaaagcacugcacacaugugcugcauguacguacguguaggcaaaauacucauaaacauguauugaucauuuguguauggugucauauguauggaaggucagaggacugucuauaggagucagcucuuuccuuccaccuuguggauccagggauuuaacucagguuguguggcuuggugguaacuacugagcuaucuugucuacuuaguuuuuuggggugugugugugugugugugugugugugguaguugaaacauggcuccguuauguaucccaggauagcuuggaacccagaguguagccuaggccucagccuccugaaugggauuacaggugugcccuauaccuggccacggucacaucugcucuaauaaccauuucucuacuguuggcacccaucccgacuaccuucucuagcuguguuccugcugaggccucuuaaagcacuuuuaaucuuguucuuuuuuugaaauagagaucccacuuuguccugccuguccccucucuaccuguccucuuccccuucgugcugcgaucagcacagcccacugugagggccaggggucaggcucauucacuauuguguccgcugcaaucaggguuauuaaguuguuauuauuaaggggcuggagagauggcucagcacuuaggagcauucagaggacaaggcucgauucccaggacccacagggcagcucacaaccacccauaacuccagucccaguggcccugauacccucuuugggcacggaggcaggaggaucagaaguuauucucugcuaccuuggaaguccaggccagcaugcagaacaaacuuauggccggcugaguaguaauggcuccuuccacacuccugcaccugucuugugaugguggcagcaggcagcccucugcccuggcccugagaaaauuaggcagggcuguuuaguagcugaccuaucuucuggccucuuacauuagucuagagcaagaguggaguucuuggaaaucgaaggaaauggacauuaauuucuucaugaauauuuugcacuauaaugaaugaaccuuucuguggcuucuaacagaaauggccaacuguuggcacuuaauuguguaacuacuuucaguugucagcuguuuuucugugacuuggcccauuuccaugacuacacccuuucauucuuggggcuugaacucagggccuggcagaugcuaggcaagugcucucucauucacugagccaccccugccuccagcccauccuugauuagacccugucugccuggagacagagugucacucugacucauuuugaaucuuauuuuguaaggagucagaggcaaaaccaaguguaagacuguggcugaaugugcacucgaguuacuggauaaaacuccaggaccaucuaucuaguccagcaguucucaaccuccuaaugcuuccagccuucgauaccauuccucauguuguggagaccccaaccauaaaauuauuuucauugcuacauuauaaguaaucuugauacuguguuuuccaguugucuuaggcaaccccugugaaagaucauuugaucuguugagacagaaagguugagaagcaacaguuaagucuggacuuucuuagcaggcgucuuuauagaccacuuuacacuacugaauggggcuucccacccaaugaggaguugggaggcuucccagugagaacugaacuaauuuggccuauaaaguaugauaacuaauuuuaugguuacucucuuuaucucucucuuuuccuuccucccucccuuccuuccuccuccuuuguacacacacacacacacacacacacacacacacacacacaccccugagugcugggaacugaacuuggguucccuuuaggaagaaucuuucuuaaccauuuagccauuucuccagccuauauaugggauuuuuuuuuucaauugaguuuaccuucuucuuuuguuauuaagacuuuuccuggcaugugucuuaucuauagauucacuaugaaauaggaaagaauuauuuuaacauauauaugcaguaguuauacacacacauaaaacauauuucccaaauaaaauagaguaaguuugaugcuucugaaggacagaacaacgcuugcagcuuaaagccugagccccccuaagaagaaagcucucuugccccuguuaagaaaaugauuggcuccugaggaaguagcgcuucccuucaaaagcgcucccuuucugugcccccugagauuugcuuggacuguguuuguuucuccacuuggggaugaggaaauuugaguugaugaucuggcuuccccuaagcugauuagccugagagcagacucuggcgauaaaagcuuuuagugaaccugauguccuggggugagggacuggaauagugaacauuuagcuagcuagggccuuccagugugggggcucagcucaucauuucucuuguaugauuugggguccauuaacacauuuuauuuauugucaauuaaaauugagugccuugucuaaaagggaugggaauuuucuccccccccccuuuucuucucucucuccuuuucccucuccccuccccuucucucuucuuucuuucuuucuuucucucucucuuucucuuucucucuuucuuucuuuuucuuuuuucuuucuuucucuuuuuucuccuccuccuccucuuccuccuccuccuccuccuucuucuuuucucucucucuccuuccuuccuuccuuccuuccuucuuuccucccucccucccucccucccucccucccucccucccucccucccucccucccucccucccuuccuucuuuauuucuugucuaauuggaucucaugcaugucaggcuaggcuggaacucugcguagcugaggaugcccuugaacuucugagugucuguuuuaugcuaggacuacagguguguguuaccaugucuguaugaaauucuaauuugaggauaggguuucaaauuuaccaaauaaaagugauucaauuuuuaaaucugucuucaauuuuuuucuuuuaaaucagggucuugagauguagcccaagcuagcucuugaucucccugacuccaccuccuaaugugcaccauccccccuuauuccaaaauacacauguacacagcucuaguuagaggucauguuuauauacaggaaaugugcgauaucguccaaagaaugguugagccguggguuuccauggugaugggaaucuguuaauggcucuagcgcuagaaacaagagagagcauuaguuuuacuuuaguccuucauaguuaaggagauccuuaccuacagaggcuaaaucuguccaugucacauagacuaggaggaggggccagggccagcgccaggaccaguggcacaaugccucccuuaagaaguuaugcauaggguggggugggguggcccuuuuugcucuuccagaggaccuggguuuggcgcccaucacccacauuauggcuuacaaccuuccauaauuccagucacagaggauccagugcccucuuaugaccugcucauacauacaugcagacaaaagacucauacacauaaaauaaguacgcuuaagaacauuuuuuuuaaaaaguuuauauaaccccaguuccaggggaugggaucacuaccaucuucucacuucugugggcgugaaugugguacaagacauacagacaagaaaaauggacacauaggggggaaaaucuaagucucuuuuuaaaggaaggaaggaaggaaggaaggaaggaaggaaggaaggcaggcaggcaauccugaaaacgaacgagguuuugucugccacuagggaaaccguauuucagagccccuggucuuuuuucacaaccuggauggugguuaauucauauuaagccuuuccagcugccaggucaaagcauaauaaaauugguugccaagagacagaaaagucuguucucucuuguuugcugagguugguccaaccgcguggguggauggcagauccucuggguguuccugugcacuaaucuccuauguauuuguaucauuagcggcaaagacaaggcgucaaucaaucaccuggcuaaacauaauagagugagcacuuuaauuccugcaguacuagccuggcuuggggaagugagacauaaagcuuuagucuguucggaugcauagauagagaucucuugcugguggcugggaacaccacucgauacgugcuugcuuggcaugcaggagccuccuucugcucccucagguuaccuaagaauugugcauguguuugagacagagucuccuauagcucagacuggccugaacuugcuauguagccaacaaugaccuuuaauuucagaucccccugccucccacucccaagugcuaggauuacaggccugagacaccguucuugguuuaugugguaccagggauggaacccaggguuucaugugugccaggcgagcaccuuaucaacugaacugguuccuggguccuaugauguaaaacuuaaauaauauugcaauaaaaggaauauggaaaaauaauuuaaaaauauuaacccagagccgggugugguggcgcaugccuuuaaucucagcacuugggaggcagaggcagguggauuucugaguucgaggccagccuggucuacagagugaguuccaggacagccagggcuacacagagaaacccugucucaaaaaaccaaaaaauaaaaaauaaaaaaauaauccauaguugugggcaggguuucuuuacuucuuguguuaguuucugucccacaucuuacuugaacaguaaggaaugccagggagaacucagcagucuguugguuguucugggcuucgcuucucuuauuagagacuaggcuaacccuucauuaucccucucugcucugcaugagaacauaaaguagacuaugggcuuucuuguuuguuugcuugguauuucugguggggguggggaaagucacucaucuaugugccccgugacugaaaacaaaagacccaccacugucaggagucacugggagucuucucuuuuccaagucacugauaaucggucguaagguaucacauuagcagcuugcaacaggggucaucaccccacccucaccagggaguuucagugucuaccugucugucugagacagggucuuuuauagucccaggcugguuucauacuuacuuggagucaguguggccuuacuggaggaaguaugucacuggaggugggcuuggagguuucaaaaauccaccugaugcucacacucccugccuccccaaaccaccuguggaucucacagcuacugcuccaguaaggugugaggccauacucccacccuggugauaauagaccgauccucugaaacuguaagccagccuccaauuaaaaugauuuucuuccuaagaguugccauggugacgguaccucuucacaaccgucggacaucgagaaagacaaugccuauacauguuuuuuguuuguugugaucuuucgagacaggguuucucuguguaauagcccugggugaccuggacucccuuuguagaccaggcuggccuagaacucacagagauccaccugccucugccucccaagugcugggauuaaaggcgugggccagcacuccagguugccucuacauguuuuuaacucuuauaagggccgcugcugugcaguggggaccggugaggcccuugaugagcacagguugcuuucaggagaagaguaagcccagccaggcaugguggcacacgccuuuaaucccagcacucaggaggcaggcagauuucugaguuugagaccagccuggucuacagagugaguuccaggacagccagggcuagacagagaaacccugucucgaaaaaaacccaaaaaaacaaaaacaaaaaaaaaacccaaaaaacaaaaaaagaguaagcccuguggcuggcaagcaaacggcuggacugcaaugucucuuugugugaccccaaaggggggcagaaccaaacagugacagggaucugggcagacaaagccuguggccaccucacgucuucagccuaccggcgucuguacuuccugaguucccagcagccuccuauagcuuugugccacggagccaagaaacuaucgagacgguaucgauugguucugcuuggcugggagguuuucugcauuugagagucagucuuggaagccuccuccuaacucuccagccccuuuugcugcccagauaaggaaaccuuacugguuacacugacacaguuguguaacuuuagaucugguuggaaggggccuugaaaaucauguggcucagccagguuuucccuuagucuccuuggcccgaagcuagguaccacaccacugagggauugacagcaggcaggauuccuaggaagaaccuuuuaaugugucuaggcugauauuucuucacugccaccagcugugagguaggcaguccaaacagcuguguuguuugaguguucaaaggaaguggcguucauucauucauucauucauucauucauucguguauuuauuuauagauagacuuuccgguugaaacccuugaacuuccaguucuccugccuuuacuucuggguaugcuagaaacuuucuuuacuucuggguaugcuagaaacugccuuuacuucuggguaugcuagaaacugaacucagggcugcaugcgaacuaggccaguacucuacccacugagccgccauccaaccccgagggggacuuucgauggaauuuuacuaaccacugaggcaauuuccuugaaacugucugaaaugacugaguaucuauggucuugacuuacauuaaagcugcccagaagugucugccacaaugauuguauuuguccuccagggugaauuuucugucagcccccagagagcugcugcuagagucgucucugcccacuuugugccgucagugaguuccugucucuacaguaucuauugcuguuugagaugagucuauuauauuuaucuugcuuguggccggccggucucuuccaucuaaugugcucucucggugagccacuguggcugacuaccuagaaaugaccuggaguagcgguucuccaccuuccaaugcugugacccuuucauacaguuccucuguggugacccccucucccccccccaaccauacaauuaucuuguugccacuccguaaguguaauauugaugcuguuaugaaccguaauguagaugucugauaugcaacccucuccaaagggguuguuauccauguugagagccauugaccuagaugagaagguggugagugcuaaguuaauaguuaacaggugaauaggggaacaggcaguuugagaaggcugcuugcuuuuucuucuuaaacgucuuaccuuauuugaugcuuauguaugucugccugcacguaugucuguguacuauguaugugccuggugcuuucagaggccagaagagggugucaaagcucuuggauuuggcauuaaaggucauuguaagcuuacaugugggugcugagaaucaaaccuagguccucuguaagaacaccaagcacuccuaacuacagagagaucucucuagccccugaacuuuauuuuaaauaacuaaauccagaauaccaguuuauuaguacauagaaaaauuuuuuucagauucauguuauuuuuuuuuuuuauguguaugaauauuuacgggaguguguaugaauauccacgggagucagagagggcauuugguccugaaacugaaguuacagaugguugggagccaccaugugggugcugggaauugaacucagguccuuuguaagagcagucaguauucuuaaucauugagccaucacuacacucacccccucagauugcucaggcauucucuuaaacaacaacaacaacaacacaacucaucccuaccuccccagagggcaaacacagaaagagagguuccugugaacccugacuguaaggacaaagaaacagaacuacucagggcuuuaugcugcaaggagccagagagacagugagucacaagacaacuucauuaugucucuuuaaagcucccuuuaaaagcagcaugcaaugugucuccuucagcgacuguaaucuguuagguuugagauuaggccuugggaaucaguuuauuuguguuuguuuguuguguauuaguguuugaccugcauguauguauauaugccauauauauauguacagugccaagaaggccagaagagaacauuggauccccuaggacuggaauuacagagggugugagugagcccaaucucuccuuaccgcugcugaccuuggcuucugcugaccuuggcuucugcuguagguggcucuuuaacaugaaagccuuggcuuguuaagcaagccaucauguuuagaugcugggacucaagggcagguucucugaaaaacagcaacuguucuuagucccugaacugccucuucagcccaaaggaaucagcuuuuauuuaaaaagacuucccagccaagacugggacacaucgaugcucucuacccugagguacuuaacuaaggcucagauaaacgugagccggggacacagaaccccaccucucugcagcauucggaaaccaguaagaaagaaccgauuuucagggcaguggcagcacacagagccucagaauuuguuggcucauuacauucagcguuguuuacuuguaacuagccaggcuggugucaaacaggaagcccucaggcacagcuuuccuuuccgguacaugguguccugugaauuagguguuagauguggggcuguagaggaaaacccucccuccauaacuucaucugagcccagcaaugugaacaccaccugagaagaugcuacggaggcaaauucacagccccaccccagagccgcugguucugaagcuggggagcucggggccuguguuuuaauacuuccagggucauccuagugcccacagagcugaaggacgccgucugugggucacagcccaaucuuuccuuaacacugcugaccuuggcuucuguagucggugacucagugagguggaagccguaacuuauuaagcacaccaucuggcuugcuuaggaacaccuauucaaaacccgagcuguccuuaggaucuuaggaauaucacacaagguggagaacaaaguccugcccagcaccugcugugggugaggcacugggcuuagagcguuuacuugguauuuuguuuucacagggauccugcugaggagaugcuaugaucugguuuacagaucuggggccugggacugguagaggcugaacacagcuuucaccuccagacuucucaccuagucauggcucugcauauugucuuccuaauauaguggcucucaaaccuuaugccacaccagguagccgcugguaaacuagugauaaaugcagauuuucuaggucucucuggaauccugauucagaggcccagguggggcucagggcuugaggguuucaucaaaggcccagaagggucuucccaugggcaucugaccauaccugggaaaaccccaucuggggcugucuccugcccuagcuggcuggcacaggccauccucaaggguucauaagguuuuguggugcuguuuugugcucacaggucuuaggggcugcugagugagaaaauagcaggagaauaugagaacacacagaagagggcuuuuguagccgagagaagucuccaaugccuggccucuccugcauccugacugccuuuugugggaggccaggccauguguugguuuugaguaacuugugauuuuuuuuucugauauuuaccccaccccaccccccugccacacuuuuguaauuuuuccuauggcggcuuuguacuuguguuuguggggagcucagaugggagcaacucccuccgagcugcaguuaacaucuguggaauagugaauugcuucagcuuugaggucagaaaugggguuucaugugcucagagagaagagucuuuauuuuucagaugggagugacaucgagagucauuuggcagcccaguaggacacuaaaugacuuggugcugcugugaaggaagaaaggaagacacacauugaaaaccaacuucaggugugaugccggguguccuuugccaguucaugcuaaaggcuagaaacuguuagaauaacaaauaccucaagggagugcuaggaaugagccugauccacaaaacgcauacugcccaagcauaaaggccugaguucaagucccagagccauggaaaaaagccgacugugagcuggguguguguuaauucuuuaauucuagcacucagaaggcagaagcaggcggcucuccaugaguucuagaccagccuggucuacagagugaggccuggucuacagagugaguacaggacaggcagggcauagagaaaccaugucucaaacaaacaaacaaacaaacauacaaacaaacaaacaaacaaacaaacaaaaaacaaaaaaaagacaaaagacaaaaaacaaaaacaaaaccgaaaccaaaccaaaccaaaaauggugugcuuauaaucucagcacuggggaaacagagacagggauuugcuggccaaaacuggcuaagugagaccuucagguggcaugucagugagauauugucucaucuaaaaacaaagaagaaacaaggggcuggugagauggcucagugggucaaguugccugcugccaagccugaccacccgaguucgaucccuggguccuacuugggggagaagagaggcaacucucuagagcugucccuuuccuccacagggaggcccagugugggccgccacacagacaaccugcauacgaaauagaugaaugaaaauguaguaaauuguaaaacaaaaccaagguggagaacuccugaagaacacacaugcaugcgaguacacacacacacacacacacacacacacacaccccuaaaacucucacaguggagaaaagggaaacuugcaugagaacacaguaaacgccagccuuuguagaggagagugguaaauguuacugaacuauuaaacaucuuugaaagacuuauuuuuauuuuauguguaugagugugagccugaaugucuguuugucugucuguaugccaugugugugcagagccuuugaggcuggaaaagggcguuggaucaccuggaauuagaguuacaggugguugugagucaccaugucagucuuggaaacccagguucucuguaagggcagccagugcucuuaaccacugagcuaucucucuagucccaaccaucaaaauuuuaaguaugucuuaaucccaacacaaauuguguaggacagagauggagaaaauuuaauaagaaaccagcuuuggcaaggugugguguugcaggccuuuaauuggguguuguacuacuugggaggcugaggcaggcagaucucugugaaauugggguuagccuggucuacauaaugaguuccaggccagccagggcuguauagugagauccuagcucaaaaaauacaaagccauaaagaaagaaagaggaagaaacucagcaucugacuuccaggaaggcacugcgcacagagcacauugccuguuuccuacuaaaaaccuuuccucacccuacguuagagcuacgugcccugggugcagcuggagccaccgcuaccaauugugugaggaauuaugggagcacugucucaccuaugcuuuagcagccuuucaaaguaguagccacauuuggaugggcuggagagauggcucagcaguuaagagcauugacugcucuucuagagguccugaguucaauucccagcaaccacaugguggcucacaaccaucuaauagcauccaaugcccuugucugaagacagcuauagaauacuuauauauguaaaauaaaaaaaucuuuaaggaaaaaaaaaaaaaaccaguagccaccuuugguauuccuguuaagaucuaggucagggacaagguugguuuuuccgggucaugggccucuuucaucgacuuaaaucugaucaucucugcaaaaugggagagucggucgccaugucagcacuucaccucacaggugacaguaagggguucuguucaucacacagaugacugcuauaaggaaacuuccagucagaugcagaccucugagacaugccucagugcccuuuucccucugggccacaugucgcucaguaagccuggcugucuagugacccagugcccaaucacugagcaacggaugcuggaagauggcagagcuuguucuagaagggcacauugacuguguugagggacagcuggcugacaugcauggguggggaaggaaaaaugaaauacaaaccaauaaugccaggagugguggcgcacgccuuuauucccagcacucaggaggcagaggcaggcggauuucugaguucgaggccagccuggucuacagagugaguuccaggacagccagggcuauacagagaaacccugucucgaaaaacaaaacaaaacaaaaauaaaaagaaaguuuugauuuucuuuuuccuccaugggauucccaggguucaaacucaggccuuuagcuaugucucauguacucagcaagccaugucacuguccccgcaaacccgcuuucaguacuucauaggccuugcauaauucaguccguauaacacaauccuaucagcuuuccuguuucacaguaugggacagugagacagaaaguuggguaauuuucucaaagugguaaguuugugcaucaaagccagucagucuuccccuagaggcuaggccuucugucaggauagguacucaauccuggagaugcaguguggccaguuugggaugucagucagucuuccccuagaggcuaggccuucugucaggauagguacucaauccuggagaugcaguguggccaguuuggggugucagucagucuuccccuagagccuaggccuucugucaggauagguacucaauccuggagaugcaguguggccaguuuggggugucagucagucuuccccuagagccuaggccuucugucaggauagguacucaauccuggagaugcaguguggccaguuugggaugucagucagucuuccucuagagccuaggccuucugucaggauagguacucaauccuggauauguaguguggccaguuugugaugucagucagucuuccucuagagccuaggccuucugucaggauagguacucaauccuagagauacaguguggccaguuugggaugucuaguaugauguccuaaaucauucgaggaaaacaaacacauuuuauuuugcauuaauucauuuuaaaaucaagccgggcagugguggcgcaugccuuuaaucccagcacuugggaggcagaggcagguggauuucugaguuggaggccagccuggucuacagaguuaguuccaggacagccagggcuacacagagaaacccugucucaaaaaaccaaaccaaccaaacaaacaaaacaaaacaaaaacaaacuacaaauguuguucaacaaggcuuauauuuuaaaaagaaaccagcaggcucuccaccuccagccauuucuagcuccccuugcugguccuugcauacacacacacacacacacacacacacacacacacacacacacacacacguaggcgcuaaaugacacacuuacauugccauggucaccuccccucaggguuagguguucuaucuugccacucuauuggggaauaagagugguugguucauuuucccagccaccucucccacacauaccacuucugacccuuuccucuccguggacaagucauauuagaaguuuugguuuaguuuuauauugaggcaggguuucucacuguguagucugaacuggucuaggauuugcuauguaguccaggcugaucuagcaguccuccugcaacuaaagacuuaugcuaccagucuuuuuaauuuuuuuuucuggugucuucuaggauuuuuacaauuuuaggcuucuccucuauuccagagucagccaaaguuggggugacagacuuuccaugcuagaccauggcccaguucauccauaacuuugagaagcccccucccccaccucucccccaccuccaccccaccccaccccaccccaccccacccuaccccacccuacuccuguacuggugaacccugcugugacuugcccacguuuugauucuauacccagauugaguuuaucucaucaacccuggcugagcucccuacagcuauuuagagccugaaaagaaaaaaaguccaaagugcuaagcuaaaacugagagcuucaaacagcuuccagcuaaggacgcuacacugcacacuuccguggccauugagguaugaaugugguuuuauguuggagggcucacuggcaggcaugggaucuuugugacgguauuugaaggucagucuuuaacaucugauuugaguucuuauuugaauauugaggaccacauaaaucaggcuguuauaaaguaagagcuguuggaagggaaaaaaagacuauucuauguuaaguugaugcuuguguaguuuaacucuugggccugcauauagcccauuuucuccacacuguuggagagucugugcuaauccguuuccucugugugccuggcucucucauuggaaauuaaguaaccauagugugaauuuauuucugaguucucucuucuguaccucugcucugcuugucauggcagugccuucuguuuuaauuacugugguuuguaauaguuuuauauuuucuuucuuucuuauuuuuccuagacaugguuucucuauguagcccugguuguccuggaacucaauuuguagaccaggcuggccuugaacucacagagauccugccucugcuuccuggugcugggauuaaaggcaugcguccccgugccuagccuuaguuuuuuaauagcuugaaaucaggaagugcaaugacaccuucucuuuuguuuguuggguuuuguuguauuguguuguguuuuugucuuuuuguugguuugagacagggucucaggccaggcugagacucgugacaguccucuuacucaggcuccugaguaugugauuauaaauacgcauggccgugcccagguuccaucuuccuagucaauugcuuccauaggagagaguguguguaugugugugcaugagcauguguguguauauauguaugugugugaugagcacauguguauaaucuuuuggguucucuguccauaggcucauauugccaacaaagacagauucuuuaguuguuacuguucgcagugcuggggcuugaacucagggcaagguugaacucugcugggagcuccgaccucaguccuccguucuucccgggaugcuuuaguuucuuucccuugccuggcugauccagcugugaccuucaggaccaugcugaagggcaguggugagugugggcaucugccuuggccuuggucuugaagaagguuuucgggagcuuggcacugagaaugcuguaggccgugacuuuguguuucacguguccaugacuguggugaggggaaugcccccuauaacuaauuucuugagagcuuuugucaugaaaagauuggucuuugacaaacaucuuguugaucauauugucuuuguucugcauuuuuuuaaaagauuuauuuauuuauuauauguaaguacacuguagcugucuucagacacuccagaagagggagucagaucuuguuacagaugguugugagccaccauaugguugcugagauuugaacuccggaccuucggaagagcagucgggugcucuuacccacugagccaucucaccagccccuguucugcauuuuuaaaaaagauuuauuuauuuauuauauguaaguacacuguagcugacuucagauguaccagaauagggugucagaucucauuaugggugguugugagccaccaugugguugcugggauuugaacuccggaccuucggaagagcagucggcgcucuuaaccacugagccaucucgccagcccuguucugcauuuuucuuuuuuuucuuuuuuuuuuuuucuuugguuuuucgagacaggguuucucuguguagcccuggcuguccuggaacucacuuuguagaccaggcuggccucgaacucagaaauccaccugccucugccucccaagugcugggauuaaaggugugcgccaccacgcccggccuguucugcauuuuuaauugugugugucucacauuuauuuauuuugggggucuacagagauggcucaguaauuaagagcucuugcugcucagguagagaaccuggguucacuucguauugagacauucaaaaucaccuguaauucuaggagaucugaaacccucugaccucccuaagcaccugcgcgcucgcgcgcgcgcgcgcgcgcacacacacacacacacacacacacacacacacacacacacacauacacacacacauacacacacacacacacacacacacauacacacacacacacacacacacacauacacacacauacacacacacacacacacacacacacgacuaaauaaaaauuuuaaauaacugguuuuuauuuuuuuguguacgagcccaugcucucgcagaggaccuggcuucaauucccagaagccacacagcaacucacaaccuccgcaagagccguguaugcucuuaacugucuuaacugcagucuucucuuccugaccccagguuuucuggaggaagugcuuggggaaagaacaauuugaguaccacgagggggccaggaucagagguguggacauauuugcagccagaauaccaaauaagcguuuaaucauggccauccagaccagaaauaaaauuuucaaacagaugaguacgaaagcaggaaagauguggccaauugggaaucagagaggaggagagggcggggccgcugaggacccuuaguuacugaagacccaggagcagaggcagcaggaaggggagcgaggaggugugugcucugagggcaggcagaacgugcuggcuuggaggugcuaguggguaucaggguagccuccccuggagacugucauuggcuuugaaggccuggagcaggcggcggcacugauuuaucucuggcuggccgcuacuugcacgugcuccuccgucugucugaaccaaguguugcauugguaaagaaacugcaguucagaaaacaaaugugcuuucuugauggugagggagacuaacacugcucccccacccccacccccaagucccaggcacaguuaauaacucugcucuaugugagaaccugcuggauuggaucuaagaagccugacccggggaagucacuugacugcucggcccagccauaugacgagcagcugagacucauuagccagacuguggguuucuguggagaaguccgauuuggaaagccuguaagauagacagcuuuucaaaagagucuuuggaaaaacuuuccuaagcaggccguuuggccuuuaccauuuucuuuuuguuguaacaucagacucaaagugaccuuggagaccaagagaugugauuagaguugucaguuggugugcuggcaacuucaaguuagagguuuagagaacaacgggcucucuccuaacucagguaugguuugcaucuguucuuuuuuuuuuuuuuuuuuuuuuuuuuuucuccugauguuuucaagaucugccaugccaacuuccaggcacugaagugguuaauuguguuagguuugaaaggccaggcucuuauuucagagcuuggggguagggguggggagucugagccuaauauaaauuuuggcacuuuggggcaguuugauguagguggcacuccaccuuguaaauguauugucacccaaaaccgggguguuggcagggauggguccucgugagagugucaagggagaccccauuccugaccucugcucuugagucugcaugcccgucuucccucuaggcaugucggggacccaguuuccucuguguguuccaaugcuuguguuccugaaggccagaggucaaccuccgauaucuuccucuguggguuucacuuuauguuuuaagacaaggucucucauggagccuggagcucauaagccaggugaggcuggcugaucaacacaccuaagaucaucuucucucugcuuccacagugcugggauuacagccaucugcucccgugccuacuuauuacaugaggucuggggcuagcacucaggucuccaagucugaggaaucaaguugucuuaccaauuuagauuuucuuuucuuucuuuuugguuugucgagacagggucucucuauguaacccuggcuguccuggaacuggcuuuguagaccaaacuggucucacacucgcccugcccuacugaucucucauaacaccugacuaccucuauuagaaguccuagcuaugaaagagguuauagccugagauacugaaaguuaguacuuuccagcgacaauuuuggagaaagauaauucaacuugaaacagauguguuugagacguuucaguaauaucacaaguuaaagaucugccuuucccaggcugcauagcuggagaggugggucagugguuaagaacauuggcugauucuacagaggauccuuacaccugauccacaaguugcagagagagagagagagagagagagggagagagagagagagagagagagagagagagucagagacuagacuuagaguaggcauuugaaaccucacuccugugacaaaccuccuccaacaaggccacaccuccuaauccuuccuaaacuguccaccgacuggaaaccagacuuucaaauaugagccugugggagccauucucauucgaaggacuaauucugauccgggauauaccacaaucaaaacauaauacaaagaucaucugaaaauccuccaaaguuggcaucaugcaggcgauauuugcggauuacugugcaguaggauuagaagcuaacaguaacaagaaagcauacugcagucuaacaggcugauggaaaugagcgggugguggugcguugcucugcauaaaugaacaccaggcacgcccagucuauaaacagaugcugauagacaggcaaacauccaguucuaagaacccacaucuaccuaggaaaaguagacagaggagagucugcguagauacuguaaggaguguaugugaucaggccccauccucuugguaaguuuauuuucauucuuuuagauucaucaauuaaagacuaugauguuuggggguaauuaaauauguauuguagagaguaaagcaguagagagaaagccuagaacacagacuuggugauggcuaaugacagaggcuuaggauucuaaggucucacccaugccacuaauggaagaaaguucuaucuggguuguuuguuuguuuguuuguuugagacaggguuucucucugcauagcccuggaacuugcucuauagacaaccaguuuggcucggaaucuccugagugcugggauuaaagauguguucuaccacgcccuccauaucaaagcuguucuguuuuguuguuguuguuuuuuuaauauuaauguguaugaauguuuugucuggugcccuuagaagccagaagagggugucagauccccugaaucuggaauuauagaugguugugagccaccaugugaacacugacaaucaacccuggguccucugcaagcucgacaaguacuguaagccacugagccaccucuucaggcccagagcuguuuucaauaauguuacucuagaauguuuucuuuucagauaaggauugagaaccuaauaaucauuguuaaaagaauucuauuuuagaaguuuuuaacauuagacaauagauugauuuucugagucuauuacacuggguuuuauuccucaucuuuuagaagaaccgaguuggugaaugguggaaauuuuuagagcuacuacgggguaagcuugugagaggcacauccaaugccuucucuguuaugccauggugaauuccuaaccaggacaguguugagacgcuugggucugugaggcauuucccuucguauaccgugaggaaaaacucucuuaauggaaaaguagaauuuccuagagaaccagccuugugggaacugagaaggguugaauaccagcagcucacuguguuuccaggagagcacuugcugguugauugcugguguaacucuaaggucagcuuuugggaaggaaaucuggagauguaggaccagagagccaaaagaugaggaagacagaggaugaccucauggggagagagagagagagagagagagagagagagagagagagagagagagagagagagagagagagcgagagcacgcgcucagguuugcuguuagagagcuacgugcuuguguggccggcagaugcagcagaugcgugacaaaugaaagcaagcuggaaauguugauugcuuggggggggggugcggggggcaucuuggaccugaagagcuuguuuccauggcugcagagcagcucuguuuaaugaaguugguuaggaugugagggaggggaagcuguauauaguccaccagaguagccuuugggaguaucugccccaagccaauggugcagcuuuuccuuaggggcggaguguuaggggcggaguguuaggggcggagugcaggauucaguacagagaacuuaaagccuacuuuggaccucauguugaagaauucagauuugauuacaacauacuggaaacaccacuccuuuaaaagcgaugaaaguaucacccugguguguuaaugaacgggcgcagaaagagcagggugcuaaauacccaggacccaauuccucuauggaugagaaaauguacaacacucauucucuuaaaaaguuaacucuaaaugaggcccuuuucucaguucuacugacaacucgggguucuuuguauaacugcuuucauuacucaauuagacauguaauuugcaggguuuuuuuuuuuuuuuuuuagaacaagagaagcagaguugccccuucacagaguagaggggcuugcuuuuugaucugguacauuucccuagccgauggccaccauugaugcucaacagcugcguagugcagcccuucgucaaccaggcccguguuccacauggaaucugcgcagaaucccuaccuggguuucagaaaggcguuuguguuguagaguguugagagauucucguuccaacuucauguccuuccuuggugcugucucuaacaguucugccuugagcagcaggccuaggggggcggggagggguugguaguggucuccagcuuaacuaauaacccccacauucaguaacuucagagccugagaguagcagauggacugcaagggaguccgcauuccaggcggcuuagguugcuccuguacuuccgugcucggagaaucuuuucuguccuaucuuugaggaauguccuuuaagugucguucuuuagccugcguggaaagcaccaggcuuacagccguagugugggauucaagcccugaccugccuggagugaugagcagagcucuaacuugauccaccacacccagacucugcugcucauuuuacccaggaggguguguugucugucgcccuguagaggauccuggcucugggcccuguucugcacugucucucuuguccccacagaaagcagccacccagugggaguagacuuugcacuucuucguuuauuuuuuaucacauucuuggagacagcccagcuucaggguucacugggaggcacacucagcugugggcugguguuucaugacagugacauauggcugugugcauugugugacugccucuguguuauuuacgguauuacucaggaagccaaucagccacaccucuacucuacacauggaacguuguagucuccucccacgagacaguauauaaaacaagagguacuugucacagauguaaguacuacacucccagaucuugguaaauuucccaaauuccaauaugucaauaugcaaauauccucaaagaggcuuuagcaauaaaugauauagaugcugccccuugaguaagcgaaaggaugguucacccugggauaaaaagcuagugucuccuuugagucacagacgccagucuuccggaucuacucaggaaaggucuaauggccucuccuucccuaucuugcugcagcccauguuaccacuuccuggucagcugcuaagggauggcaaccuuucacaaauccucgguggacuuuggaacugacagcguuuaaguuuucuucaagcugguuuuuccucacacugacgcuaugugucuuucugaaccuguauuaaggguaagaauagguuuuaggacugaggcuguaacuccgugguagaagacuugccuaacccaaacaaggcccuaauuugauucccaacaccacuaaggaagagaaaggggagggguguuuaaaaugaauaguguccuguaggcugggcaugcugccacucaccuuuaagucuagcgcucagaauucagagcaggcaggccucugaguuugagaccagaguuguguaaguagugguguauccaugccagccagggcuacacagugagauucucccuaaacagcaacaacaaaaaacgcaccuuauugcuacgacaggcaagccggcuuccuggguaaagauacuugcugccaaauguggugacuugaguugauuucuggaacccacaccguggaaggagagaaccaauguuugcauaguuuuucuauggccuccacacgugcucugcuccccaccccacccccaaauaaauagaaaaaaaaaaaaaacccucugcacugcuaauaagucgaggcgacugaccauuuggaucaaucacuggcuggaaucuuucugugaguuaccucagugcauaaaucucaucccugcacuuaguaggguccuuaugacggcuggcuuuacuugucaaguugauacagccuagaaucaccugggaagagagucucagugagggauuauguagaucaaggauuauguaugagcaagucuuaacugauguggugaagcgguccccuggguuugaacccugagcuguccaagggcaggggaaaaguugaccaccaagcaugcaugcaugaguucauccucuuuguucuugaccauggauauggcguggccggcugcuuccaguuccugccguugucacuuccugaaaugauggacugccuucugaaguuccgaccuaacguguauguacauacacauauagacauguaguaacacuuggaggagagcaaggaggacagggaaaggagaaacuauaggauuauaaucccaaaagcuuuuuuaaaaaguaaaaaacaggggcuggagagauggcucagcgguuaagagcacugacugcucuuccuaagguccugaguucaaaucccagcaaccacaugguggcucauaaccauccauaaugagaucugaugcccucuucuggugugucugaagacagcuacaguguguuacauauaacaauaaauaaaucuuuuuuaaaaaaaaaguaaaaaaggaaacaaaacaaaaaaccaaaaaacucaagauuccccuuaguugcuuaucgccaggguguuuaucgggagguugguggcuguugccuccguuuuauaauugaagggaugaggucacuuuuaagcacugggacugaaccguguaaggcagaagaggaagagucagaauugggaccuaugcaaacccucuuugggaaggcucucucucucucucucucucucucucucucucucucucucucucucucucucucucucuguuggaaaucuauagaccuaaggaugauaaauaaguaaaagucccuaugucuagugcuguuuguggcauaugacaguguccggcaaugugucccucucuccuuauuuuuugagacagucuugcugugcggcccaguaaccuuuccugcgucagccuuuugagucucaggguuaagggcaugauccgcuaaagcucaucuccuuuuguccgaacugaaaccacuucccucauuuacucccuggaaagcaauuuaccuaugucuucaguuuuuguuugucuuuuuguuaguuuugguacuaggaauuaagccuaaggccuugaacugcuagacaagugcucgcccccccccccccgccccccuugcaucuucagguccuuuuacuguuugaguagacccuaucaacaaguugcccaggcugccuuuucuauccucccgccuuagccucuggaguagcugggauuccuggcuuucaccaucaggccccgcccuccucuugcacuuuuuuuuuuucucuuuuaaauaaggaagcucucugccuaucuggcacuuaucuaacaugcgguucuuguugaggaaauggguguucugugcuuucuauuguuagucugaugagaaugaggguggggagcacuuugagaaaauauuuguguaaggagggagaggcagaagccaacugagugcgaguguguccacucagaaggugccuggagcuuuugacccugauggaggcuuugaaacaguacuuccuccaggagagagggacucagaugugugaugcacgguuccagugcccucagcacaucuuagcuugacgaauuuaguaaucuucuuaauguagaugaguuucugggcauuuccuagcaguucugugagucacaggcuguuagaugacacugaaugcuggguauuccacacacagcaugucuuuccaucuucagggccguugugugaggggguguauuaucacgguucuuuuuucuucgaagaucuuacaauucuuuauuuuuguguguauggguuuguaccugcaugcagugucugaggaagccaguagagggcgucagauccuagagcuggguuuacaggugaucaugaggaguugaugugggugcugggaaccaaacccggguccucuguaagagccacagguguucuuaacuaccaagccaucuagcccccaggguuuguuuguuuguuuguuuguuuguuuauuuuaaaccaaaccaaacaaacaaaacacaggcagugugguggcacacacauuaauuugaaacuaaccuggucuacacagcaaguuccaggauaguaagggcuacacagagaaacccugucuugaaaaaaacaaaacaaaacaaggcaacaucauuaauaaaaauaauaugggcagacaguggugacacagauuuuuaaucccagcacucaggaggcaggugggucugugaguuugagaucagcccacucuauagagugaguucugugacagccaggggugcacagagaaagccugucucugaaaaaaaaagauuguaaaauaaaaaauaaacuaaaggguuggagagauggcucagcguuaagaguacugacugcucuuccaaagguccugaguucaauucccagcaaccacgugguggcucacaaccaucuguaauaggaucugaugcccucuucuggugugucugaagacagcuacaguguacuuauauauaauaaauaaauaaauaaauaaauaaauaaauaaacuaaagcauagguacccgacugaccagcguuucccaaauuaacauaaagcacaaauaaagcagguacagggucuuuguugcuucuauugcagaaccagagccccuuugcuuccauuugaagcccccaccuuccagcugacuggagccugucugggucugcuuucaagucuuagcuccguuucuguacaacacgaagccaggcucuagcuucaugugcuccucguuuggagagcucaguaauuccgaguucagugucugcaaggagaaacuaugaacacagccaccccucaguaaagugucacccuuuauauccuacaaacagaacugugaagguugguaaggcucugcccuuauccacugggccaguccuaucugcaauaugaggucacgggucuacgcuaaggcugucugaggaaguucuccacggcagcucuaggggcugagaaguuugaauuuuuaauagucaccaaguugaggcuucaggcagggguagaagaggugagugugaggagaagacccucgccuguacuuuuauucuaaugaagcaccuaguguugagccuaggaccugaguagacaguaugagggaauggagaggcauggcgggcaccugaugugcgcauagaugggcagacccaccuuucaugagcaggaugaggugucucugugagggggacggacagaagaucauuguucugauugucagagaguuuguuagcguuugacaugugaaaugagagugcccaggacuuuccuggagagggguaugugugugugugugugaauauguagcccugacuggccuggaaugccacauagaccgcuacauuggcugacuuaaacucacagaaaucugcugggcucugccucccuggcacugguaucagaaguguguccccccugccccuacagcuccccccauaccuggugagagacuuguuucucuuuggauuggaauugugugcugcaucuguugagaagguaaaggcagauggcgagagccucacggaggagaaaagcaaccgcggauggguacugcuggggacgaugacauuuuucuccuuugugguggaguuuguuucaguugaucuugaagaauuuugagcaacuuccuguuagaaaacccagguggagguggauuuagcuguggguuaugguuucuacuccacuauggaacccacuuccugaaagagcaugacagcuaggcagucugaccaauaaguaggaaauaauaauaguguauacagaagccaucagaacaauuugaccugugaauuaaaagugacuuauuuccuccuccuccuccucuucuucuucucccucuucuuccucuucuuccucucccuccuccuccuccuccucuuucuuuucuguuuuuucaagacaggguuucucuguguagcccuggcuccuugaacuaacucugaagaccagacuggcuuugaacccagagaucuggcugucucugccuuccaagugcugaguuuauaagugugugugugugugugugugugugugugugugugugugugugugugugcaugugcauacggaggucagagguuggcguccgaugucuuucuccagcccucucucuguaccuuaccuuuugagacacgguaucucacugaaucuggagcucaccaguggacuagaccggcuggccacagcugccuauccccacacugugauugggguagggauggaccugccuuugcgugugcgugcuagggaaucagaacucaggcccucacacuugcacaguaagugcuuuauggaccgagccacuucccaugagcauaaaaacgaauaagacaaacaaaauuauuuaaaguccaaguggaaagagagagagaccgggaucuagugcugaaaagaugaccagcagccacugaguacugggagucaccacucaugcccugucccaccuaccugccccacuugucccacccaucccauacgucucuuucuguacauuuucucauugaggcaacaucucaacucagguuggccuugaacucaggcuccugcaucccuuccagguacuggggucggggacauguaccacugugugguauucucgccccgucuuaugcuucucuuuucucacuuacuuuucccuuuucuuauuggagacagucucacuaugcagccuugguuggaugagaacucacuguauugaccagguuagcccccaaagucaugggcaauucuccugccucuauuucuggauugcucagauugcagguguguaccaccacacccaccugccccuucuuugguucaccagcuuuuguuuuauguggucugccaugacugugguuaacuguccuacagacauucccacuuggagucuccuucuuuauauaaauucuacgguugaguucaggaaagccagagcuacacagagaaaccccaucucaaaaaaccacucccaccaaaacaaaacaaaacaaaaacccuaacccccaaaacuuaaaaaaccaaaccccaagcccuaaacuguuauuuauguuucuaugagcaucucagucaccaguuauuagguucuuggggacagugaacaucucauuaccuccccucauggaccccuagaucaggcuguuacacagaagcaccuguggaaagccaggcacgguggugcauccugucuguaacccaagcacuugggagcuggaggcaggaagaucaggaguucuagaccaaccugaaguaccugagaccuuccucaaaaauaaacagaaucaccaacagacagacagacagauggacaaaacccccaacaaaguaugcaaacaaauacuuauugaacagaauauuguuacuuuaauauagaaaauuuuaauauuuuuuugauuaaaaauguaugugugugugucagagagagagagagagagagagagagagcgcacagacaugcauguaugcucacaugcuauggcaugcaugugucagcagaccaccuuguggauuugcuuacgugggcuccagggauaacccaggucgucagcguugcauggcgagugcuuugaccagugaggcaucucaccagcucuaauucucguauuccugguggacuuuccuaacuccguuucuucgugucuuacaggugaggcacagaguucuccaucaugucggauggagauuacgauuaccucaucaaguucuuggccuugggagacucugggguagggaagaccaguguacucuaccaguacacugauggcaaguucaacuccaaauucaucaccacagugggcauugauuucagggaaaagagagugguaaguucugcacccuucauaagaaucuaaucugagucaacaaauuaacgggacuugagaagccaaagguugggaccuaaaguuacaguacacaagaaaguggcuagguacaacauccaugccuuuaaucccagcauggaggcagugguagggauauugaguuugagagcagccaggucuguauagcaagcaagcaagcaagcaagcaaacaaacaaggguucugugcucgggacacuugauauaaaacccuuuggacacaguuaaaguccauauuacuuuuuuuucuaaaacaacaacagccgggcguggugacgcacgccuuuaaucccagcacuugggaggcagaggcaggcggauuucugaguucaaggccagcccggucuacagagugaguuccaggguuauacagagaaacccugucucgaaaaacuaaaaauaaaaaaaauaaaaaaaaaaaagaaaagaaaagaaaagaaaaagaaaaaaaaacaacaacaauaacaauuacuuauuuugggggcuggagagugacucagagguuaagagcacugacugcucuucaagagguccugaguucaauucccagcaaccauauaguagcacacaaccaucuguaaugggaucugauugaugcccucuucuggugugucugaagagagcuacaguguaugcauauacauaaaauaaauaaaucguuuaaaaaaagaaagaaagaaaaaaacaauuaaaaaaaacccuuauuuuuaaucagguauaugugugugucccugugaguguaugguuacacucucccugcccccgcucuccguguguguguguguguguguguguguguguguguguguguguacccauggaggcuagagguguuggauccucuagagcuggaguuauagguguuugugagccacuuaauguaggugcugggaaucaaaccuggguccccugcaagagcagcacgugcucuuaaccacugaaccaugucucagccccugcagagaacauuucuacuagcauuuccccuugcuccccuucuggcuuauaucuuucuuccugaauaccauugucuaccugucuaccggugucaugaagucugucagccaucuugccucuucuggucugguuggcugggcugggccuuacaaugucucuuacaccggcaucgucuccucuuuaaccgcagcucccuuaccuggagccuagagcuccacaggaaacaccaugugccaggagggccagggugggauggcagugugggauguuaccagugaugcagugugcugcagaaugguggugaggaaguauguguguacaggcguuguguauaauaggagugcagggucuucuuauaggggaaggggaaaguaggaggucauaaugcaaggagcgacuaugaccuuccaugaaugguguuguuugaaaaacccaguuauggugcuacugguaaguccccuaaggcugaagccaaagagucuucagcauguguauucugucagggaagcugcacgguccccagcuucucagacagaacaagucagucccuuuaacccaggauaggcccuuucuacuaccagccguauuuuaucacuuuagggucuuucuauguggcccaggcuaaccuugaacucuugaacaccucagacucagaguuacaagcaugugccaucacacccagcaaccagaguaucugacagacauucagacucacugcaagagaugcgugcccuaagagaugcucauggucacauagccgauggagaugucacgucgucaguuuucugucucagggcucaaccacauggagucucccaguguucuacugugugcuguguaguuaagucuaggaugauagaugugagucacugaacccguguagacuuucaaguuucucucugucugucugacagagucuuugucuuuccauccuucccucucucuuuccugcuccccuggccaaugugcagacuuuccucuuggcauuauucugaccaacacaguugcaauaacuucaacccacagagauuuuggaagcguuuguagcaauaaccucaaccugcagugaucuuuggaaguguuuagaggcuuugguaucacaugcuagggcugauggugugcacacgauuguuuuugcuaguuaccucucgccuugugacccagcuuguuucaugcauggaguucugaggguugaagucagggccuugugcaugcuggguguucugccacggagaggcaacuccagcucuuccuuuuggucuaaagcagauuuguugauguauaauucucaacaaguaaaaucaggggcuggugagauggcucagcagguaagagcacugacugcucuucugaagguccugaguucaaaucccagcaaccacaugguggcucacaaccaccuauagugagaucugacucccucuucuggugcaucugaagucagcuacaguguacuuauguauaauaauaaauaaaucuuugggccagagcaagcagagacgaccagggugagugggguugacuggagcgagcagagguccuaaauacaauucccaacaaccacaugaaggcucacaaccauuuguacagcuacaguguacucauauacauuaaauaaagucuuaaaaaauaacaaguaaaauuaguccauuuaaaguguagaauucagcagauuuuuuucuagcauauccauggcagcagauucacacgaugucuccaucacaauuaauugcuugcauauuucuuuguugauuuacuuagguuuucggauugauuuauucuuguuuuaugugaaugauugucugugugcauguaugauauauauguguaccaccuaugugccugggacccacaaaggccagaagaagguaucacauuccccggaccuggaguuauaaauggucgugagccaacacauggguauugggaaccgaacuuagguccucuacaggagcagccagugcucuccagcucaacucguuuaguuuuugaagacagggucucacgcagccuaggcuacuuugaauuaauccccugccucaccuuugggguuauaaguaugugccaccagcaacuguuuuuucuuuugagacaaggucuuaccauguaguucuggcuggccuggaacuugcuguauaggauggucuugaacucacagagauccagguauuggaacuaaaagucuucaccaccaugcccagcaugaacauuuuuaucaucacagaaauaaaccccgauaaugccauugccuaucgcucuuccuuccagaguugccuaauucuggaugugcuguauacaaggccuuugugucugucuucuuagacguagcaugucucgagguucauccguauuguagcaagcaucagacagaaucaauuuuaaaauguuuauuuuuauuauguuuaugagagagugggguggguugggguaccugcagaggccagaagaagacauuggauccgcuggagcuggagcuacgguuacauuaugaacugccuguugugggcaucgggaacugaauucagguccuuuccaaaaagcgcccgagugcucucaagcaccgagccgucucccucacccuuguaugcaucgauuacggcggcagaguaagauuccacugugcuaacaugccagaugcaucugcccagugcugaugaggauuuucacuguuuucuguucuagcuaugaaaaugauccuucuguaaauauucuguuuuccuguggcauagauuccacucucauuguuuuauuuuuacgaaaugaagccggaguuuauuaggaaaagguuuggacauagauuuaagcacaggcauggggagggagaaaagauuagugcugaggaaaaggacaggacggagacacggguagagggagccacucuuuagacucuuuagggucuuaacaauaaguggccaugccucacugguagcuucugaagucauacuuguuguaagcuggcccgcagccuacaugagccggguguuucuggaaggcaggcuggugcugaaagagacuuagacuucgagaaaagauaaugagccgggcgugguggcgcacgccuuuaaucccagcacuugggaggcagaggcaggcggauuucugaguucgaggccagccuggucuacaaagugaguuccaggacagccagagcuauacagagaaacccugucucgaaaaaccaaaaaaaaaaaaaaacaaaaaagaaaaaaaaaaaaaaagaaaagaaaagauaaugaagccaagacagauguucugaucaaggcccgagauuuuacucagagacugugcuuaaaaaggggaaagcccaucccccgccaauccauucuuggugccuggagccagccugcaggcgaggaugugcaggauaggaugugccucuggaauaucucaggggccucucagcagguagcagugucuuggaggagagcagcggcaagugacagaacaauggagccaucuaggucggaaggcuccaccccagguggucucauucucaguagcagcaagguuugcaacagccagcuucaggcugggggaggcuacacguacuguuucaagggcuucugaaaaacaaaacaacccaaaauccccuauuuuucuucuuaguaagaaaccacuggguaguucccaagguauacuggucaggauuacaggcugauagacaaaaccacaggccacaaggguugaaggaaucuuuacuccaugaggucacaaggaacuuaagaccuaaguuuuuuuuuaagauuuauuuauuuauuauacguaaguguagcugucuucagacacuccagaagauggagucagaucucauuacagaugguugugagccaccaugugguugcuggaauuugaacucuggaccuucagaagagcagucgggugcucuuaccuacugagccaucucaccagcccaagaccuaaguuuugaucauuagaaaaguucauaaucuuguuugugaagcucucuggaagcuacggguuuauaguaggaaggagugauacuaacuguagggguuauagaugcugaagucuuaagccugguuccuugcucuuuuaauuuuauuauuaggaauguuugcauaugaaagaaaaaguuucucuauacaacaaaucuuauuaacaacuggauuuuuuuuuuccguuuguuuuucaagacaggguuucucuguauagcccuaguuguccuggagcucacucuguagaccaggcuggccccaaacucauaggaaucugccugccucugccgcccaagugcuggaauuaaaggcaugagccacuauugcccaccuguuuuuguuuuguuuuugagacaaggccucuauagucacggcuguccuggaacucugucuguagaccaggcuggccugcaacucacaaauucaccugccucugccuccaagugcugggguuaaaagaggacaccaccuuugccaggcuuuuuuuuuuuuuuuuuuuuuuuuuuuaaguuuauucugaggggacaaugcuagagauuagacauuuauuagccaaaauuggugucgcugucccuggaagccagcggugucuguuaaauaacuauagggacgguuguugaugaauucgccaagucugggacuuuucucaugaacaagcucugggugaggacaagccugggaauggagcugcucuuuagggaagcuuucugacaagucuccaaaccugcucugcaguggcugccuggccagcugagguucucuaggcugucaugcugguccauuugcuguuguuuguuuuguccugugguaugugguaccugggaucagaccuggagucucauguauaguaaggcggugggugcuaccccacugaacuacugagccauaccuccagcuucaaucucucucucucucucucucucucucucucucucucucucucucucucucagagcuuucuuuucuuuucuuuuuuaaagauuuauuuauuuauuuauuauauguaaguacacuauagccgucuucagccacaccagaagagggcaucagaucucauuauggauggccaucucuccagcccuccccccucucaaauggggucucacuguguagcccuagcuggccuggagccugcguuuuuagcccuggcuugucccgcccccugagagcugggacaggagugcccauguauaaagccauuagguuuuguauuuauuuaauuauuuguuguguaugugugugcaccugugcugugguucauguauagaagucagaagacaaucugugggaguuggcucucuuuaccauguagguccuagggauugaacucagccugcccuugaacucaaggcaagcacgguuaccuacugaaucaucucccuggucucuauaaaaucauuuccagggcacuuccuaaagauaagauaaggaaaagccacagaaagucaguguuuuuuggaauaaaauaaauuauuuuuauuaaguuugguguuuuagagacagggacuuauacauucuuggcuggccucaaauucaauuugauauauagcugcgagugaccuuucuaucuucugucucaccucccaagugcugggauugcaggcaugcaccaccaugccugcuuuuacgguacaggggguggaaucuggagcuuuguggaugcuaagcaagacuaucaacugaacuacacccccagcuaggucuuaguaggaggugccauugcucaagugugguuauugcaccaaagucuaaaccuggcucuguucgggacucaauucucuugagaagucuaaaugcuuugagauuuugugcugaaucgaaagucaagaagagcccgcuggucucagaauuucccuuggcuuaucuuugcuuugcuguuuuagguguacagagccaaugggccagauggagcugugggccgaggccagagaauccaccugcaguuaugggacacggcggggcaggagagguaugucuccccagucuguccacacugaccugggcaggagaggugugucucccccagucuauucacacugaccuggccaggcaaaggcagccaacuggcucaucugcaccugguaagaugagcugccagaucuguguuggcagccugaguugaugguaacaggcacauuuucuccaaggucaaaggagauguaaaucucaaaauuaacccuucauacuugggacucauucuuucucccguuucaggcucuaggcuucuccccacugccuucugcgcucugcucaccaguaagggagucccaagggugcuugcuuuguucuucucuguugcugaggccugguggaacaucuggucgggaugaauuaaucugauuauagguuacuugacugaaaaaaaaacacaugacacuuuggugcaaggcugcuuucaguuagcuacagccucugauuuaucucagucuucuggaaggguguguguguguguguguguguguguguguguguuguguguguguguguguuuugugugcuccugugguuaugcaugcacacgugugaugugggggcccaagguugacauuaggucucuucuguaguugcucuccaccuuauucauugaagcagcgugucucaccccagcucagugcucacacacacagcugguccagcuauguagcuuauucugagaaucccccaucucaggcgccucugugcugaauuuauagguggucugcugugccuaccuaauaguuguguggguuccggggauccacucuggcucucaagcuuguaugggaaacacuuuaaccacugagcgaucucccacuuuucuuucucucuuucucucuuuccuuccuuccuuccuuccuuccuuccuuccuuccuuccuuccuuccuuccuuccuuccuuccuucucucucucucucucucucucucucucucucucucucucuuucuuucuuucuuucuuucuuucuuguuuuuugagacaggauuucucuguguagcccuggcuguccuggaacuugcuuuguagaccaagcuggucucaaacucagaaaucugccugccucugccucccgagugcuaggacuaaaggcgugcgccaccacgcccggcucccauucuucuuuuaaugauaaaagaaccaaaccaaagcaaaccacccauagaaaucuccaaguguauguauaauggugaagagauguaacugaaccugugucccuuacucagaucugaucauuuccauguuguggccauucucauuucaucucuccccuuaaaacuccuccucccucccucccauauuaccuggagggaaaaaauuuaaauaccacauccugccauccacagcuauuuugguauguaucuauaaacaguaaagacguuuuaugagaccauugaauacaguaauugaagaaaaccuacuauuucugacuagcugguuacuauuuggcauuuccuucuguggagccugccugucaguuacagacuagacauuuaggcaaagcgagaaggaacugagagaggagagggacagcaggcaaagccugcgggaggaagcauaccaugacagguccacccagcaccauucccaccucagagguagggaaaugguugccagagagacgucuacagagcuggaagugaguucuauugacuuguagugaccugaaaccuccccagaaggaggagacacauggcugacacuguugguuuuggcuuggugaacucgaguuguccaaugauuuccuggcugggaucucucgugcagccgguucagucuuccauaacacauucuguucacaugugaacuugggggagugguaagccccugcuugagagaacuuuguuggaauagcugaugucgcuuuguagaaugcugagggugucagugacagcuuuacaguucaggagugggaccaugcauggcuugguuguuaaguuucaggacccgggacaagcagcagaggugccuauuuaacauaucagagcagaccgggccuccagguucucccagggucccuuagucccugccuguuacaggaucuggcugguauacuccacccucuacccugaacucuccugccccagagcugggccacccuucuuccagaaguucuucccuguauaauccagaccugggucagccacuccuccuuagcuccuccuuuugugccuuuggcuaccuggcugcuguuucuugcucgcucucucucucucuccccuccccucuccccacaacauucaagguccugcucacucuagcccccccagaugugucugcugcuggcuaugcucucccacaaauccauaacaaacuuucucuuccaccauacuuggagccaucauguccuguccuuuucuuuuuauugacuuauguuucauucguuagugaccaacuguuuaacugcuuuuuuuuuuuuuuuuuuuugugcccuagguuucguagcuuaaccacugcauucuucagggacgcuauggguuuccugcuucuguucgaccugacaaaugagcaaaguuuccucaauguccgaaacuggauaaguacgugugguuuccccagcccugcccugcuccuggaccugcucugcacugccauguuacgacauguccacucuauggcugccauguuauauauucugcuggaaacagcucagugucgaggcuacuaagaauaagcccuucagcuuagggccucagauggcagacauccuuuguucccuggagcugccuuccccagggagcugcuggggacccuuccucauccucucaggaaggggugagaagagccuaagggugagccagcccacugaaggagccugaucagagagcugcugcccuggaacucgcuuuguagaccaagcuggccucgaacucagaaauccgccugccucugccuccccagugcugggauuaaaggcgugcgccaccacgcccggcucagaauuugcauuuucaauaaguucucagggguugcugaggcugcuagcccauaccacuuacacagagagccaauaaaucaguuaaucuugguucuggaaaguaaguacugucauguucauuuguagaucaggaugcuaagguagucacauaacuucccccucaagaugagggcgugcaggggguuggguaguggaugaggagaacagccagccagcaacagagccaagcuuccaacaguaggagauguucguaaccaugguaguagacguuggagguucugggagagcgcagaagggaccaguagagaagaggauggaacagaucuugaaggaaguugugucugggcauuaaagagugugggaacugcacauuaacaaccuaggguagaagaggccugccuuguacaggaaacagggcacaguuaguuagaucuugccugggcaggucuugugacccaaguugucucuugaaagcgaagaacaauguccugaaauucaggcuuguguuauuuaaggcuuggggagacuuccuccuucuucaccuuccccugauaagauauguuugaccugcguuugugaggaggaacugaaguggcaacgcuccuggcugauagggacaaagcacacaugaugucacgugcucugagaccacugguugcaaaauuucagaugcuuccauuucuggcguguugaggagaaagaaguuggguuuuauguuccuccuucggaagauggaacuauuuagcaccauggagcuccuuucuuuccuuuuaaaagagaauucauuuuuaugauauuuuaauaaaaaucuugugucuguguggguaugcacaugugaguacaggggucugggaggccagcgcagcugguggugaugagccacuuaguugaauggugggaacagaauccggcuccucuggaagcgcaguaccugcucuugaccaccgagccaucucuccagccccuuuuuugcuuuucauaguuaagacuuuggguucuuuccaaaaguuacagaaucugaauugugguguccuguguccccuggucuuggugacacucauuuacuauuuauucucucugucuucuuucaucaucaaaccgcaguuuuucuuugcuuguauaagacaagaucucacuggguaguccaggcuagcucugaacucagaguuucuugccucagcuucugggauuacaggcaugcaccaucacaccugguggugacggcaguggcugcggcugcugcuucuccuccuccuccuccuccuccuccuucuucaaauggcaguuuauaaagggaaagggggaaccccaguuaggaugaguugguuccuuuugauuguacauguuaacuaggugagccaaaaggggccuuuugaauccuggacuucaauacuuugauagcuggaccucaguggggaggaggaaguagcccaauaagggacuagaccuugguggccaguuuuaggaauguaaucugugguucaccaaggcagagggaaaguauucuaccagcucuuuacuucuguauacucauuugagguuuguauacucauuugagguuuucagaagcaccuuugcacggauuuucuguugaucgccuguuuacauuaugacuuacguauaaccaacuuucccgugccuuaggccagcuacagaugcacgcguacugugaaaacccagauauagugcuguguggaaauaagagugaccuggaagaccagagggcagugaaagaggaggaggcccgggaacuugccgagaaguacgggugaguauuccuguggugggguccagagggaacagaaacauuagccagcgagugacugaaaagagaaaagagccaacucagugucaaacccucagauuucacgucacaguggggaguuugagagcacacacgggguggggguggccucugcugucuccgccccucuuggcaaguucuuagauuuugcaggaggagaguuuugaaugcagccauacugacuuuagugccuucuguccaacacgaaaagagaagauuuuuuuuuuuuuuuuuugagacaggguuucacuguguagcccuggcuguccugggacuuguuccuuagaccaggcuggccuggaacucacagaucugccugccucugccucccaagugcugggauuaaaaggugugcucggccaucaccuggcuaacaaaagacucuuggaguaaggaaauccucuguguuuggcaaggaaauuucaaaaccacuuugcauaccguugcagaguucuggcaguagagguggccuuugggguaucuaucacagagcaggugaugacuuugaugggaggaaguauagccgcccuuggcuuuaaacugguuuugagugaagggccaggaaaugcugacucucuccucaagcucuuggagcggguucauggaggcaccacagggcuugcacaugaaaggagaaggugacaguugcuucacuugacuccugucccuccaggugggcaggugcgggauuucugggaaaggaaaagagaaauacaagagagaaagcauuacagagugggcagggcacgacuuugugccucuagcagcuccugcuucaccugagauguuguguuuauaaaaagauaaauggagaggggaauauguuuuauggauguguggugagguaugagggaaaggggcaucucagcaggcccaugcugaggcaacccuucccccugagggacuagccacacaaugguauaguauagaauaaaguuuauucagggcauguggaggggaguuaagaggguaggagagacagagagaggcagagaagaguagagaaauagaggcuggccaugagcacguggauagagaagggggaggggaauggggagagagggggaauggggugaggggacagaggagagcaagaaagcaagagcaagagagagcagagggggcaagcagccccuuuuauagucaggcauaccuggcuguugccagguaacuguggggcagagcuuagacaaaaugcuaauauggggggcuccuacccauccugcuggcuuacucuuaugaggagaugcaguuucaugccaggauagacggugucaagcccuuagaaacaccugggagcuuuguacaguuuggucucaccucugucacucagucauguggaguguuagcaguuaaguuucuguugaugcuuguauaugaagagauccuggccugggggaugugaugacacgguuggcagagugcuuaccacacaagcuugaagaccugaguucaauggcccccacuccagagcccccguuuaaagccugguguggugguacaugccuuuaauccuaguacucaagagaccaaggcaggcagaucucuuugaguuugagcccagccuggucuauauaagugacacccuaucuuacaaaacaaaacaaaacaacaaaaauaaaacaaguuggguguguuagcucucauuuaaucucagagcuagacagcagaaacaggugcaucccuggggcuugccugccagccaagcuagcauaguugguaaauuccaggccagugagaaaucuaucaaaauaaaaacaagguggauguugccacucaggguuaaucucugccuucaccuacaccuacauaagugcacaugugcgcauaggaacaugcaagccugugugagugcauguaucuguugccgagaucugccuuuaugucauuguaguuacagagucgcuggaacucucucuuugugucugaugcugauucuugggcuucacaggaugggcugucaggaaaagaagcugauugcaaacuguggauuggguauaggaaaugaagagcgacuagaauuuauaugugucccaaaaacugccggcagcugucgccucugaccucgguggcgugggcauccugcacaagccagucgcuuuaucuuagcuaaucacacaccugguuuagcagucucagugcuauggagaggugaggcgagggggugggacaggugcaagucugguugcuaggcugcaccaagaugagucagcagguaagugccuacgugugcgaaaucuuuaaaggguaaugcuucacuucccccaugccucuccuguggcccacccgagaccacagagcaauuucugggaaaugcucagccaggcuacagugguguacuauguggggaccugggcacuggugccuuuaacggcuugaggcuggcagagccaggugccaggcaguucugguacggcuccucccucuugagaggcucucaaaaguguggaaaggaaacugaggggccaaacaccacaagucugacugaagugcugaaagggaugcuguuuugcaagggcauaggaggaagucggccaugaggcaauagaggccacaguucuugcccgugcuuuugagaagugaauguaaaaguagggcagggcggucagaagagucuuucaacaggaugucucaagcacccggagaguggaagggccaaccuggcccacucuaggccuucaucagaucuuuccuuguuacagcaugcugggucucgggauccuguagucugcccagcaucagagagccugguguugcuuucuguuguacgaggaucugagccaugcagggacugucuuucccuguguccagcacacacgugccacggaagaggucacaaagaugggcucuaaugagaaacgguuuuaacugaugaggauaaaggaaaugccaggaagagagaggggagagauagaggcuguccaugcuccuuuagucacggaagauaacuggcgcugggaauaaaccccuuugccauuuuuauuccgaauggagagagccauggaaacugugaaagggguuaaaggacaacugaauggauauacuugugugcugugcacauaauuggccacagauuugagaacucuguccccccugcuggucgcugaugagggaaggcacuccaaguuucugcaacagaagcucaguugaaaaccuuuauucagugucagugauagaugcaucgccacagaccaggcuauggauuuccggggucugaacucggcggugcuccgugauaacucagaacuagggaauguggucugaauuuggucucugaucguuugaucccuuguaaagaaauuaaugggggccggagcgauggcuccaugaugaagagcgcuugucaacucuuguagagagccaggguucgauucucagcaccuauucaguagcuuacaacuccauaacuccagauccaggggacccaaugcucuuuugacuuccucagacacaaggcacgcacacggugcacacauagacacacacgcaggcaaaacacucauacacauaaaaauaauacaauuuuaaaagaaauaaauuaauguauuauugugcauacauugaaacaacauaaguaagcuacaaccaaacacacaagacugacuccuggaagccacuucaaggacgcagcguccagcaagacucgccaucaauucuggauccacauguaagccaaaugccuagacacauuugacaaaacucucuagagaucaucauugucauucugacgacuucuacagugcugggggcugaacucuaggccuugcacaugccagacaagugcuuucuuagugaauauaugaauauauguauauauguguguguguauguauauauauauauacacacacacacaguugggaggcagaggcagguggauuucugaguacgaggccagccuggucuacagaaugaguuccaggacagccagggcuauacagagaaacccugucucaaaaaaccaaaaaaaaaaaaaaaaaaauuuuguuuaaacuauguuuguauagaugcaacuacccagaagguccaccauagauaucagaggcauuaugucucucuggagcuggaguuacaguugugagugcccgauaccggugcugagaacugaacauggauccucugcaaggacaguaaggcacacucaaccucugagccaucgcuuaaucccuggcaacuugguguuaagguuccaguuuugucaauaaguaaauaauagaaguaauuuuuaaaauuaauuuauuuuuuauuuauaugaguacacugcagcuaucuucagacacaccagaaaagugcauuggaucccauuacagaugguuguaagcuaccaugugguugcugggaauuaaauucaggaugucuggaagagcagucagugcucuuaacugcugagccaucucaccagcccgugaugaauuuguuguuguuguuguuguuguuuuucgagacagguuuucucuuuuuagcccuugacuauuuggaacucacucuguugaccagccugauacaaacucagagaucugccugccccugccuccugaaugaugagauuaaaggcaugugccaucaccacccacccuuuuaaaaacacaucaaaauauuuguugucuccaggaacucccaaguaacuauuaaguggccauuuguuagguggcuauaucaaccaaccauuuuucauaccucuagcaagagcucucccuggcaaugcugcuuuagcgccaucuuguguacauaagggauaguaccagcuuucuauggugaaaguaaugguccuuuugaauuuauguucagguaccuggacuuguucucagauaagaauuuggaaaagaaaacauaagcaucagacacaccuuuaaucccagcacuccugaggcagaagcaggagggucucugaguucaaggccagccuggucuacagaaugaguucaggacagucaggagggcuacacagagaaguucugucuugaaaaccaagccaaaccaaaagaccaagcugcucuggaaugugcagaacuggugccucuggcaugcugggacugcaggcaugcaccaccacauccagaaagaaugcuguuacuaagaaaagccucuccaugucugacugugccuauuuuguuuguuuguuuguuuguuuguuuuguuuuguuuuuuaaagauguaugagcugggcgugguggcacacaccuuuaaucccagcacuagggagacagaggcaggcagauuucugaguuugaggccagccuggucuacaaagugaguuccaggacagccagggcuauacagagaaacccugucuccaaaaaaccaaccaaccaaccaaacaaaaaaagauguauguauuuauuuuauuuaugaguacacuguagcugucuucagacauaccagaagagagggcauuggaucccauuacagaugguugugaaccacuaugugguugcugggaauugaacucagaaccucuggaagagcagucaguguucuuaaccacugagccaucucuccagcccugacugucuguguuaaguguuguaccugugucugucucaggcccuuagcaccaugaccuccaguuacugcuccuuuucacggauaagaaggcuccagagcuauguggggagcacagugcuugcucuacagcuuagaauacuugcuguuuccugacuguucaguacugacucuccuagaauucacgaacauagaccaggcuggccuggaauucacagagaucggccugcggcugauaucguguggggcucugugaccaauccagagucuguuguugcuuuugguuuugaagcaggcuccugucagaugguucugcgguccaggccagccuggcacuuugcauacgcaagucucggcuucccaagugcguuuaacacaaacuaacaagcaaacaaacaaaagcauaacacgguaagcugagagggguggugcacaucugcagucggaauacuggacaggcugaagcaggaggacugugaauuugaggcuaccuugacuacauagaaaaucccaaacccauuugaguuaccuaguuaaauccugucucaaaaaccaaaagguuguggguguugcucacucauggauccaagaggguguuucgguugaacaggggcuauagggugugugagaaccuauguaggaaugcagggccaggcauagugauguacacccgaaagccuagcuugggagguagaggcaggaggauccuaaguuuaaggacagccucacaacacaacaaauuugaggaaagccugggcuacauuagacccugucuccaaaaaaaaaaaaaaaaaaaaaggagaggaagggagaaugggagggggcuuuaauuucucugguguugggaguguuaaguuucaacacugcccccuccccaccccaccccuacacaaaagcagaccuggcuuccagauucuuccagaaucucucagucccuuccugugugguggcauacaccacccucuacccugaacucuccagcccagggacucuucccuacauaauccagacauuuuggauaccugcuccacuuuuguaccuuuguccuccucucucccuccccccccaccacacacagcucagggucaugaccacucuggacucucccagaugccccaaccuuuggcuauacucucuccugaguguauaauaaacuuucuccuccaccacacccaugagcagucuuguccuuuccuuccuuuuuuuuuuuuuuuuaauuuuuuuuuauucagggagcacagagguucuugcaucaacagaucauuagggaaaccagggauguuaagcauacaaaagauuucuuuucaaagaaaaagauguaccaccaguuuuucacccagauagcuagcuguggauguugcuaacguccugauggccuuagcuaccuguagagccagaacacacccaaauaccacagaauguuuaucccagacacucccuccaaagaccuuuuauuuuucgguuucucaaucaacgggauacauauacuuuauagacccaaggacgucuacaguuugauggagacauaucagauccuccccuaggcaccuaagcuacuacauggagccuaucucuggagcccgucuucuuggaagaaguaacauauacuuugaguuugagguuuuuuuuuuguuguuguuguuuuguuuuuucugagacaggguuucucuguguagcccuagcuguccuggaacucacucuguagaccaggcuggccuugaacucagaaauccaccugccucugccucccaagugcugggauuaaaggcgggugccuccccgcccggcacuuugaguuuugauauaauuaugcuucccugugcacuggcuauuguauuacaccaagaacccccccccccccccccauuguacugcacuuaaauaaaccuccuggcgucagacugcagaaggaaacauuuccuuuccggcugugaugcuugcgcacacgccccuccacacacacaccugaaggucauucugcuauuacuuggcgcuccuguaaucggucuccaggaaacgccccgcucaauucucuguggcagcuacuggugguugccuagacgacacuccuagcccaccccuccccuccucguagaaguccaguuuucuuuacacauacagucugccucaggaugaggcuguuugagagagucggguacaaacgccagcccacgcagaccgauugccuucuggcaauugcgaugacgccauuccuuuaagccuaaacgggcauuuguuuuaggugcuggcaaaagauauccuuuugaaaaaugaaauaugaggguacgguuuugagagguacacacaguggaauagaauucauuuuuuuucauguaauuuggcacacugaauuaaacugaaacacugucgccuccucucugggcacuacugaagucacacuguugucauguauauuuauccucaauuucuccaaauccugaauggccaaaaaaauuacgaagggcaaaagucacugucuuucuucccacauuguuaccccagugauuucugucuuccagaauccccuauuuugaaaccagugcugccaacgggacaaacauaagccacgcgauugagaugcuccuggaccugaucaugaagcggauggagcgguguguggacaaguccuggauuccggagggagugguacgguccaacggccauaccucugcggaucagcuaagugaggagaaggagaagggguuguguggcuguugagacgccaagcgagccccguggcagcagcgcaugaccccugguugccgccagcuccgcuguagagaccaagccggcagcucgaugagaugagcaaacagccccuccuaugccaggugccucuccucgccuccaggagggucaccucgggcauccaucuguaacgcgcugcagcuuuguaugauuuaguccaugaaucggaagaaauacuucacagagccaaaagugucuuauaaaagcccacgguggcgggucauuuagggauccaagauuucagccaugaaagauuucaucuguuauguagaacgcugaugguccugucgccugccuuaacacagucgccugccucaacacaggacagcccuagagucucauugaagacauuaagaucuuugagcaaggaaaagcuagcacggucuugagaauccagauuucaaaauccauacuguagacuaucacucucaaacacgugaaugucaauaaguguguacacacagaucaaugucuuucagcauugcuuuuuaacauagccuuuccuuugacaugagcauaaacagauggcggccauaccuauagacucugaauagaucggauugacucacugugaguuuggggguggggggaaggguuuauggagcaggggugggugaaguagggaucagucagauugucugcuguuagccgaggggucaugaagacucuugugucuauccauggucuguuggguucagugcaccucugaacaucgcucaugcuucuacaguauguauguuugcauguauguauguauggucucuucauauguacguauguuuggucuggcaccucaggaucugcuuucacuugucuggagacugccaaucugacuuuucccaucaaguuuuggugguggugguguuucccaguuuguuuucucccccccccccuucccccauuaauguaacugaaggaaucucuuuuuaauuaaacggcguguuuauuugcuaucuggagggagggaguucacugucuguauuuaagcagucacauuugugggccaguuuaagagaaguguuuuguagccuguagcuuucacugggaauguggggcacugauguuuuuugauaguggaaaacauacuuugcaugguaguuucaaguggcuuuuuuuuuuuuuuuuugagacagggucuuuucauauaguuucuagcuggcccaaaacucccuuuguagacuaggcuggccucaaacucacagagauccaccugucucagcacccuaagcacuggggauuaaagguguaguugucacaccuggcucucagaagacuuuuaaaaaauugcacaucuaucauuuauugccauuguccuuugaccccuccucagaaaaaaauagccauggccacuaagcuuuuacuguuuuugaaauaagggacucuuugaaacaccaaacucaucauugaggccuauacaucugaauccuauauacccaggacaugaggcccaucauagccgugccuuccagcguuguucuaagacuucaguggagcauacugcuuguuuggcacauuucuuaaugucucucuuguaaauacaucaagucaauaugccagacagguauuggugguucguucuuuucaucucccauacuugagaagcagaggcaggcgaugaguuugaagcuaggcuucacuauagagugaguuucaggacagccaaagauacauagugaaguccuguuucaaaaaacaaacacacacuaggcaguggaggcccaugccuuucaucccagcacucaggaggcagaggcagguggauuucugaguucgaggccagccuggucuacagagugaguuccaggacagccaagacuacacauaaaaaagugaauguuugcacaguggcauagugcggguuuugagaagugagaugccgcuccuguuggcuccacaccaggcacggggcuuaaugugugugauaguugcccaacacaagagcugccuugaauuguugaaacaaaacaaaacugaguucucugaaaaugguuuaaauuugauaaaaaaaaaaaaauaaccguacuuuuugucacuguauuuuucuauuuacaaaucuguauaaaaaaugcucuuuagugaacuuugugccaauuaaaccauaauaau

SEQ ID NO: 12163 - RNA, 13496 nt, Mus musculus
agcuguagcagcggcagcuagaagcagcagcuggggccccuggugaggugaucgugccauugccguguccguggguccacagccaggugcucagaccacaagccagagagaaagguuggguuugccagggaccagggcaggggggcagcugcccaggagcuuucaguaccgcugcguaaagcuggucucagcucggacccugagucugguucgaucaaguccuggaccuucugggauucccaaggggccccagcucaauggggcugccucugccgcugcuucaauccucucuucugcuaaugcuucuuuugcggcugucggcggcguccaccaaccugaacuggcagugcccacgaauacccuacgcagccucccgagacuucagugucaaguacgugguccccagcuucuccgcggggggccggguacaggccaccgcagccuacgaggacaguacaaauagugcgguguuuguggccacacgcaaucaccugcacgugcuugggccugaccugcaguucauagagaaccugaccacuggcccuaucgggaacccuggcugccagacuugugcgagcugugguccaggcccucauggaccaccaaaggacacagacacacuggugcuagugauggagccagguuugccagcccuggucagcuguggcucaacccuacagggccgcugcuuccugcaugagcuggagccucgggggaaagcccugcacuuagcagcuccagccugccuauucucagcaaacaauaacaagccugaggccugcacggacuguguggcuagcccccugggcacucgugugacugugguggagcaggggcaugcuuccuacuucuauguggcaucuucgcuagacccagaguuggccgcuagcuuuagcccccgcucgguguccauccgucgucuaaagucugauacuucuggauuccaaccagguuuuccgucgcugucggugcugcccaaauauuuggccuccuaccucaucaaauauguguacagcuuccacucgggggauuuugucuacuuucugacuguccagcccaucagugucacaagcccucccagugccuugcauacacgucugguccggcucaaugcuguagagccagagauuggugacuaccgggagcuggucuuggacugucauuuugcaccuaaacgccggcgccguggagccccggagggcacacagcccuacccagugcuucaggcagcccacucugcuccaguggaugccaaacuggcuguggaacugagcauuucagagggccaggaagugcuuuuuggggucuuugugaccgucaaggaugguggcucuggcaugggucccaacucuguuguaugugccuuccccauuuaccaccugaacauccugauugaagagggugucgaauauugcugucacucuucaaauucuucuucccuguugucgagaggccuugacuucuuccagacgcccaguuuuuguccuaauccggugagcagaaagagcgggccccugaccugugaguacccuguggagcugaauacgggcuauuuccuugcuaucucugaaagggccugggugggaaaaggcagugggcuaagacacacaaaucaucagccaugucccggaaggucacccagcacgaggcugucauccuuccugccaucugauucuuuaagauagcuuccaggguugugugaggaggggcuuacgucauaguuaacccugccagcacaacuuccaaauuccccuccaaccuguccaguuccuagacccucagggacaccgagaaaaauacagacagaggcaaacacucagagggcagagccucacaacgguccgcagcggcuugccgaccaguucuacuuuccuuugaaggcacuguuuugcucugcuuuucaaagaggggugguuggcagggcugccagagaacuccuccccgccccaccccccacuccgugagguuccagggaacccuggaagucugggaguuuuuuuggagagccuguaugaucugugauuuaccaacccauucuccacacugucguuaugggaaaaaucugggacauaguggaaaggcaguuuuagcuccgcucuagaaaguucugggaagccucaccccagucuugugcaagcaacgauaagcaauugaggaaggaugaauaaaggcgugggaggggacgguuucgauugguccacccuggacguuuugucccuguagccaaggcccugccccagguaggaggucucacagcugguauuauagcacaucagggaagaaaagaaggaacaggaaaaagaaugucuuuaaaacgcuacugaggggcuaggacuuuugagagguuagugggagacauugaauggagcauuggaugagccaucaauccggcucacagucacauucuuggaggcucuggccacccagugcccuugcucugcuaugacaauuuuuuguuugccuccuacucccaacaccccuauggccauacuaggaacuggggguugaaucuggggccucccaccugcuagucaaaugcucuaccaccaccgaggcauauccccagccccucuccucucccuugauaauuuuaauuuugaaacagucucacuaaaguugcccagucuggccuuggacucauucucuaagcccaauccauucuuaaacuuguaaucgucgugcuucacccucagggggugggggguguucuugggccguggucuugacucgcuuguuucuagcuucuguuaguggaggugugaaauuuacagccuguguugcagucaaaagucauuuuucuuuagaaccugaugaccaaacccaggagcucacacacacuaagccucuaccacagguuauauugucagccuuuuguuguuguuguuguuuguugguuuuugagacaggauuugcuauauagccaaagcuagccuugagaacauuguguaguucagguuggccuugaauucaauauuucccugcuuccaucucucaaaugcugguauuacaggcaugcaccaccaggccuggugcuuauuuuuuuuuuuuuuuuuugguuuucauuuugagagauuaaacucauggccuugaacauauaaauguucuccugcuggggaacacccccagccuuggugugugugugugugggggggucaucuuuagccugggucccucagcugaguauauugaguauauuuagguugagaaguccuaugagcaagaauguuuggucugaaccuagacaggaagucagaaccucucccgucuuaacuagugccgaguagaucaggacugcaucgugccaggcaccgggagaacuaaucuuaggcccugccuauccgcucuaggcaugggggugugccaggucuccgaagauauguaaaucaguguuuauccaaugaguucaaguaugacaccguguuaguaccagccucuguguguacucaaugguugauccuaaagacuagugccuggauacguggauucagauugcguguggagcauguauuaggaaggggacacugaaggcgaguguuuucagggauaggcaccuuugucaauccuaggacccagauugaagacuccagggugucggggcaagcaagcagcagcgugugcuuaccugagccacuaccuccuuaacgacacagccccaccugugccugagucacggagaaaacaguuggcaagcuuccggcuagggccaggcuccuuuccuucucaaguuaggacaagguuccaguccacacccaagcaggauauagacccagauuggguggggugucuagacccaacacugcuuccucuugacccuccccaucccagcuucugcuuaucacugaggcccaggaauggguuaaaucugugcaaccugaaggagguucugaaaaccuaggccucuccugacccuucuugcuccucuaacccagcuccacauuggcuuccugcuguccuaggaccauucaugguucuguccuaagaacuuacagcccccaacacuccugccuaaaagccagggagagguuuguguccugcaaacaucugaggcuuagcccgccggcccgcucaagguuagagggccuuguauuuuuuuuuuuuuuuaauuuuuguaccugagggagguguagguaauuguaggacuuauggagucccagggaaaggaaccauguugccaacuuugggaagccaccuaaccucaggauucaguccucuacacaaguagggaaacugaaauucaagagggacauuggcuaagauguacgcacagaggcagcaggagcugggagaguacccuggauccugaaggguucgugaggccuuggauaaaugaauggauguguggguggguugggucuaggagauuaaauaacgggucaccagacuggacagagcaaggcaaggcaugaaguagggaucuggcuuucuagacugggccuccuuucuucccugcccuugcugucuccaggagccuccuggcauggugguagcauacgagggguaggcucuaggccuccucuagucaagcacggugggggucacaguuugggauugcugauagacuaacaaaagcccccaagagucaaugcccaggccugaccccgacucuccuccuugccuuugccuuugccccagccugguggagaggccuccggccccagcucccguugccacuacuucccuuugaugguccacgcuagcuucacccguguggaccucuucaauggacuguuaggaucagugaaggucaccgcacugcaugugacacgucuuggcaauguuacaguggcccacaugggcacuguggaugggcguguccuacagguauauccuuuaccccacagccaucuggucccgcauuccuguccccugccccugcuacuuuuuucucauagcugaccugucacagguggagauagccaggucacucaacuaccugcuguauguguccaacuucucccugggcagcaguggacagccuguucaucgggaugucagccgccucgggaaugaccuacucuuugccucuggggaccaggugaggugugcggggucagaacuuaggguucaggguaaugggagcccagagaggcauugguaggaagaccuuaccucuccaaucuacaaaggaaccaggaggaccaacaguucucaccuuuagccaucccugaccuacccguuugucacccuaaggucuucaaggugcccauccagggcccuggcugucgucauuuucucaccuguuggcguugccugagagcacagcgcuucaugggauguggcugguguggggaccggugugaccggcagaaggaguguccuggcuccuggcaacaggaccacuguccgccugagaucagugagguacagcuuaccccagcaggguacaguaaccauggggcaagcggggauggggguuggggagggacaagcagguugugguggggcugggggggugugagugucaaaaaguccugaccacaaucuuccucggggaauccuugucagaggggaugacacaugggaaacuugggugguaggaaaagucugauaaggacuagcaggugacucagaauggccagacugugagauguacaaggcauaugacacgggacucuuggggaggcagguggggcugagagagugcaaucucacauaaaaccccagggcucuucucucccuuucaguucuauccucacagcgggccucuaaggggcacuacgaggcucacccuuuguggcuccaacuucuaccugcgaccugaugaugucguaccugagggaacacaccagaucaccgugggccaaagucccugccgacugcugccuaaggacucuucaagcccuagguauaacauggucccugccuucccuauccccgaugagauugaccaagcggccccucauuugugagacccacuucugugaaggauaugggacaagcuguauuggcucuggcuucuugugucccugucccuuuuugagccugugugugcucuacuuacuugucuguuuagcuguggacuagacaagguuagcccacuugauccugucccacucgauccugccugccuucaggagagggcauggguggagaugcuccucugagguucagagaagccucgugacuuacggcagaggcguagccagcccuacaugauucccaacguggugcccuuccugaucuuccaggccagggucccucaaggaauucauacaggaacuugaaugugagcuggagccccuggucacccaggcaguggggacuacaaacaucagccuugucaucaccaacaugccagcaggcaagcacuuccgaguggaaggcaucucuguacaggaaggcuucucuuucguggugaggccacagugcccggucuuugcccuuggaucaugggugguacgagaagggugggcuuggaaugaaugguuuguuucagcugagccucuuccacauccucucaggagccagugcugacaucaauaaaaccugacuuuggcccgcgggcuggggguacuuaucucacccuugaaggccagagccugucugucggcaccagccgggcugugcuggucaauggaacccagugccggcuggaacaguaaguguuaucagguaaacuuaugggaagccacaggacccuaccuuugggagacuccaagugguaucugcguccugagguggcccuccuggcugcugccugaggucaccucaagucucagguacaacacagucccaaucuucuucccugucccccaacggagacaaccaagcagccccuuccucgugagacucuuucccacccagagagccucaccagguggguaccuaguuacugccaguguggagagaagagagucaguuguuuggucaaaguagggaucagugccaggagagaucugcuguccucuccagcccagagacaagagagcccaccacagaggccacugucuccagccaaggauaugggagcuuguuaccucccuguaacaagcuucuuuuuuguuuuuuaaagauuuauuuauuuauuauauguaaguacacuguagcugucuucagacacuccagaagagggcgucagaucuuguuacagaugguugugagccaccaugugguugcugggauuugaacucgggugcucuuacccacugagccaucucaccagccccaagcuucuugaaggucuuacugggagccuccucucuccaguccguggaguguagauggauggaaaagacagccacagaggaaguggaaaggauuaguaagcccuggaggagguaaaccugcucauccuaagaaggugucccugugcccaaucccuccuuccugcagggucaaugaggagcagaucuuaugugucacgccuccuggagcuggcacggccagggucccccuucaucugcagauagggggugcugaggugccuggcuccuggaccuuucacuacaaggaagacccuauuguguuggacaucagucccaaguguggcuacagguaaguuccaccucucugacuacuuuggccuacaggacaugagagcaccagcucccugaguccccuaaacccaccacccuaccccuucucacaguggcucccacaucaugauccauggccagcaucugacuucagcauggcacuucacgcuaucauuccaugauggacaaaguacaguggagagcagggugagcagagcgggugacgaccaggagggaggaaagcuggaccaguccccugauguccaacuucaccucacccugggcugaggagacugaagcagccagggguuggccauuugccuaacuacuuucccaugggucucagcagugugcggggcaguuuguggaacaacagcagcgucgaugucgccugccugaauaugugguccgaaacccucaggggugggcaacagggaaucugagcgucuggggugauggagcagcuggcuucacgcugccugguuuucgcuuccugcccccacccaguccacucagagcuggccugguugaguugaaaccugaagaacauucaguuaaaguugagguggguuuaacgguuaggggagggacagcggauaaggaggcagagcccagacucuggcugauccuucugucugucucggcaguaugucgggcugggcgcuguggcagacugugugacugugaacaugaccguggguggugaggucugccaacaugagcuccggggggauguggugaucugcccccugcccccuucccugcaacuuggcaaggauggugucccauugcagguaggugacacagcuggcccucucaggaaaccaugagcugagggucugcagucuggguuuaaacugccaucugcuuucaggucuguguagacggugggugucacauccugagccaagugguucgcucaagcccaggcagggccucacagaggauacuccuuauugcucuucuggucuugauccugcuuguggcugugcuggccguugcccugaucuuuaacucccgaagacggaaaaagcagcuaggugagaucccuacauucaucuagacuaagccuaacaguagacuccccccagaacagcagcaucuucaaucuccagacugggggugggggugucucccacuugguccccgagagcuuggcaagacgaagcaccaugggcugucuuuccacaguccuugcucccaaucuggaaugacccugcaucccuggauccgucccccagagccaugccccugucuauauuccgcuguggcucugacuacagaaguguccuuggugagaugggggaggcagcaggagccagagcucgccuuuccccacaggugcucacucccucuccccaacaacacucucugacaucaacgauacagcuuccggggcuccgaaccaugaagaaucgucagagaguagggaugggacaagugucccacugcugcggacagagucuauccggcuccaggaucuggacaggaugcuccuagcugaggucaaggauguacugauuccccaugaacaaguggucauccauacugaccaagucauuggcaaaggugugggggauggauugggagguggggcaggggcauagaagggguauugcugugugcucgaucgagacagcuggagcaguccccacuucgacccgcacacuaacuugugugaccuugaggcugccaaacuucugagauguggucaucuuuggaacgagguuuuggagaauuugcucuucgguggcuucugguguggcuguguggacgcgggaggacuguaaacgacccuaccauugggcugccgcuugcuuuuaaggucacauuggccaauuuggggguucugagguugcuaguuauaaagggcacacugugagucugggcacagaguccuucuuuacccucuugcucuuucuaggccacuuugguguugucuaccacggagaauauacagacggagcacagaaucagacccacugugccaucaagucucugagucguaagcgaggcauaggcaggguggguagaagggugaccucaggcugcagguccuuuguaccugcuaugcugccacuuaauaaagugagccuugcguggaaccuuccccuuccugcacuguuuccaccugacccuuguaaaggaccuucuugcccuuggccugccugaccuaugcuacucugcaggcauuacagaggugcaggagguggaggcuuuccugcgggaggggcugcucaugcguggccuacaucacccaaacauccuggcucucaucgguaucaugcugcccccggaggggcuuccccgggugcuguugcccuauaugcgccacggagaccugcuucauuucauucgcuccccucagagggugagugaucauuguccagguugggaggugucagccagcacccaccccugccuacgcucaccagucaccuugugcccccagaaccccacugugaaggaucuugucagcuuuggccugcagguagccugugguauggaguaccuggcagagcagaaguucgugcacagagaccuggcugcuaggaacugcaugugaguggcucaaguaacugaggugaagcaagagggcagguugcucgaggaucugcagcuccuaaaggcuaccucaagggaggacccagccuuugcucugcggccuuaggcacuuucagucuuucugguauaggguuagacacugugguucuuaaggccuucgaaggacuuggaucagaucggggcaagaccuggugggaagucaguucuuacccggccagugagcuacagccccagcuggguuccaguucaaccugugauucccucuccucaggcuggacgagucauucacagucaagguggcugacuuuggucuggcacggggcguccuagacaaggaauacuacaguguucgccagcaucgccaugcucgccugccagucaaauggauggcacuggagagccugcagaccuacagguucaccaccaaguccgaugugguaaggugcccucugcuccagaacugcuugacccccauuauaccuuacaggauuuugccuugcuuuucugcaugauccgagcauagagacuccccaaguuaggcaacccccauaccucaucugucuuggacaaacgugaaauagaaucugaugccggccaggacaaacgaaguuugugaauuuauugguuccguaugaguaacccagggcuuucagcucugaaguugugagagucaggggaagaaacucgugugccauugaggauugagcucugggcagaaaggugggagugucgccuauuuccagugaagggcucugagaaguggaagaccuggggacccaccugcccccaaacuuggggugaucauuugaaucaguccccucacuuuucuccaacaguggucauucggggugcugcucugggagcuacuaacacggggugcuccacccuacccccauaucgaucccuucgaccucucucacuuccuggcucagggccgucgccugccucagccugaguacuguccugauucacugugaguauguaaaagggagcgggguggggcagggcuggacuccagacaggaggugggggcaacggaccaaguuccugccuuucugucugacccuuugguugauugggacagggagcaucucuggggcucaguuuacucaucuguguacugguucccccccacccaugcaaggaaggacucugagaggaccucacgguugccaugguaacagcauuccaacucagagucuggguugaggccagugguuugguuucccagaucucuuuucccacucgacuccugcaaagggagaggggcuguuuucuaucucugccacucgcuuaaccucaaagaaacguucugccagcucccacaccagccccucugcgucuccccaucaaggucuuuuuuuuuuuuuuuuucacugcacguaguucagacuccucauucccaagggauggcagcagccgugucauccgugcccgugggguagguuugacucccuaaucagccggcauaccccagcugugcucaagucugcaugcuuagaacagggagaaccaggucacagguagagcggcugaugacuccugucccaggcugugcuccagaaagggaaugaguagcucuuucuuacaguucuccccaucuuggccuugaccuuucuaucaucuguuuuacuaauauauauaguuugaauuauggaaauuaacuucacugccugccugcaucuaagacaggcucucugaacagauuaggguggggauuucuacaugguagggcuucagugguagguuugggaguugggggguugggguuggggagaaacagggcuugucagaggaagagggcaguugugaugcaugggagggguggaacucauucuauauaggacuguuagaguugggcuggcccugcagagaccaaggggccaggucucuaucccaggcacuaaucagucacuggucacaggcuauacucagugagcagaugugagauugggcaagauauguucccgccugccuaaaggaggcugaagcuaagagccuccaacauguaacagucucagccacugagaaaacgaaggagauccggguggcacacugcagagugcacuccugggcuccguuuugcccaacuguaaaguggguuuuauaacacuccccucagagagugggagacauguauaagauacugcgcacagacacuuagacucuuaguccaggcagcaugccaucccuaugacaacaaggcaugcucucagaugcagcaggccagccuacugcuucagagccuuagcuccagaaccacuguagggacugcccacaggcuucucuuucaguccccauuuaaacucucccaggacuguuuugcugcugagauuguuugauguuuuuguuucguuuuuuuaaagacugggucucuguaguagcccaggcuagccuugaaugcaggcuaauucuccugcuucagccuucuaagcccugggauuaaaggcauguuucacugagcucauuauguguuaguugguuugcuuuugagacuggguaccacuauguagcucuggcuauccuagaacucacuguguagaccaggcuagucucaaacucuuuauguaacuaaagcugaucuugaacuccugaucuuccucccuccacuucccaagugcuugaauugaaggugcaugccacuguaacugacucucuaugcaggguuuaaucuucauuuuauauccuaucuggaagaggugugaugauccuauuagcuccuaagccucuuagccaugugcugaggguuucacaaguuuaccccgugaaccuagagcugugaagaggccaucuaggcauagaaaagucaaggaacauacccgaaaucacauagcuaaggccccgggcagacucaacccucuaccugaccuccaucuucuuacagguaucacgugaugcuucgaugcugggaggcugacccagcggcacgacccaccuucagagcccuagugcuggaaguaaagcagguaguggccucacugcuuggggaccacuaugugcagcugacagcagcuuaugugaacguaggccccagagcgguggaugaugggagugugccuccggagcagguacagcccucgccucagcauugcaggagcacgucaaagccccggccucucucagagccaccccugcccacuugaccaaagcccugaguaggccacaggcacuagaucugcuaaguggccuugagcaaauuacaagcugccucugggccuaggacaagccucagcauggaaaaccuccacucuuuagcuuucuggggccacugaaggugggaaaccgggcccauuugagccccucguuccagcaugagccagugacauuuuuguagcauguauuuauguaaugucuguuuuguaccuguuucggaauacagaggauccagcagugaucacagagauacuacaguguaaaauaauauaaauaaauaaaugaaugaauauucgagcacaa

SEQ ID NO: 12164 - RNA, 31736 nt, Mus musculus
cgucaugcuccacgcgucugccaugauugguuaagcgucuagcucucagggcguggaugcguucuugagcaaucguggcugaacugagagugugcgcgcgugcgcggggccgcgacuggcgccagcucgagcccgcagggcgcucggggccgcgcacgucgcuccccgcccucccgccaccgcccgcccucguucgcucgcgcuccccgcccgccgcccgcgguccuccgucgguucucuccauagcccgccgucucccacggagcugcccguccuuggcucggagcucgcggacucgcggacaagcguccucagcgcgaagaggccggacucggaguccucgccuugaggugagcaggagcauuucccuccagccgccucggcuccgggcccggcuggucggcugaucggcaagcacuuuuccggccuccggcccgucgccugcccgcggucgcgccccaccugcugcucucggcccgcagccccucgccccggccccugaccuggggccccgcgcccgaggcggcggccccgcccgcgcaguccccggaagcgcgccccgccgccuccagucccccuucccccgcccggccgggccugguggagcccuagccgcccgcccuccucgucgcuuccucucaggguugcgccgggcugggcgggggcucccggccgguccgcgaccgcgcugggguagccugccacugcgaagcgcguguggcugucgggaguuggacuaggcaagaaacucuuuuacaacuccauuuugccuuuugcauugaacguggauuauuaaucccguucuauaccgggugaagacagugaggguuuggguggauuuucuguuuugagugccguauuauuggagauuguguaaguaaaagauuguuuugaaaucuuagcgguuaugacucuaugggggaagguauuuuccagucgaaaaaacacauaauaauuuggcgagguugcaucaaaauagaugcauuucugcuuaaaguuauuacuucaauuaagaaucacugauggguuccccuuuucaggucgguuucguaaaauugcauuuuuugcaggcaaguugauuuaaaaaaaaaaaaguucauguuuaguagcugauaguggaaaauuugacaccauuuuuuuucuuuuuugccccagaauugguucuacuuguauuuucuaauagucaucacuaaauuuugaccuauuaguuauuuauuugguuuugucuucugguauauuuugaaauaagugcuuuuugcauguuauauauaacauuauauauguauaauauguaguacacguauaauguacaucccccaugccagucugaaaggggaaaacuuauauuuuaggaugcgguauguggugagaauuuuuagccacuuagugucacgugcccaaauguguauguaccauguggaauguuuuuuucaccuuucauuggcuaguuugagcauuugacucacguauuauuaaacuaagaaaacaagaucaggucuuaauauugaagacucugagauguuguuuggaguauuucuccggagcagugacguuucuuagggacauaaaauauauggagcuuguuuuuuuccuauuuuauuuuccucuuugguguuggcuugggacacagugaacaggugcuguaucucugagcugcauuucagccuuacaacuugggaucaaacucuagugcucaacuuacauagcuucuacucaaaaaucuacugaacaggagaauaggaacauccacucuacugauuguacccccaauagauguaguauuuuagacuggggaggaaaaaaaaaacuuuaggauuuacaaaccaauuccguuuguaggugugggaacugagcuuagggaauuuuuuucucuuuccuucugugugugugugugugugugugugugugucugucugucugucucucucucucuuucuugagaaaggcuuauuacuccgcagagagaacagugggugugauaauaccagaagaaccacugaccuaagacuuaauuuaaaaaaaaaaaaaaagacacugggucugaccugagaccuggaacuuaauuuguagauaaagcuggucucuaauuuccacaugcuccuagugcugccuccggaacagugcugggaucacugggugugugccaccauuccugcugagacuuaaaauguuugaaggucauacaucuaguuagacuacaacuauuuuuuuuucuguuauucuccaugugcugucaguuaaaaucagaauuuccagguuacuucagguucuuuaccaugcagauuaugcauauuugggaaacaaauuucauguuuuuguaaguaguuccuuucuggcuaggccuugccuuugaguguguugguuuucuuaaggaccggguuuugagaguuuacuguuagcaaagauaagguaaugagguccagcuagaauguuuucaagacuccuuugagucaguuuuaaauggaauuggugagaauuugcauguaucaaguagaccauggucuguacaugugugagagugguuuuguuggagugauuucauaguccuuuaaaaaguccaucuugcucuauuagggguguaaguaaguuacuagaagagugaaaacagaucuucagagcugggugugguggcacacgccuuuaaucccagcaggcggauuucugaguucgaggccagccuggucuacaaagugaguuccaggacaacgagggcugcacagagaaacccugucucgggaauaaaaaacaaaaacagaucuucaggcgcuucuuaguccaugggugggguugaaguaguaagaagaggucaaguaagaaaagccaaacuagucuuuugacuuguccuuaaagagccaaaagaucaguuaacuucauugaaagacuaauuuaagaucagaggguuuuuauagacagcauacuuaguucuauuguaucauagcuacuagcaaugaugacaaauugugcauaaauguugaauauaaaaauaggaaguaggugaggugacaaaccuguaaugaaacacuccaggcauuaggaggauuucagauuugagaccagcuuaggcuauauaacaaaauccugcuucaaaaaaaaaaaauguuccucuuaauucuauccaguggaacucaauuguugcaccaaagcauuaagaauguacguuaccuaucugucuuuuguuacugggaaugaaaccuaacuuugauugguagcuauacgauuagccucucucuaucuuaacugauugguuacuuuucagccugaagcuuuaacccggggcauuacauauccuaggcaagggcucugcugcugaaguacguccugaacccugauuuuacuuuugagguagucuuauuacauugucagggcguaauuaugaacucaccugcagcuuucaaccuuccucagucuccccaguaacuggguuuacagcuaugaggccugacuguaaccaaguucguuuuauuuauuuauuuauuuuggaggcaguuacacucuaggugagguuagcuuggaaacuuacacuguggcccagauuggucuugaguuuguagccguucucccuuaguuuaguuuagcccuccugagugcugggauugcagggguugcagguaugagccaccauaccaaacuuacaauauuuaaguaugcaucuuacuuacuguuaguguuuuggugacauuagauauuggugacaauaaguuuugaaaguaauuugaaauuaauuauuguaaaaucccuaauucuggugacuuuuuguuugauuggagacaagcucugucuggcuuggagcuuuguaguccaggcugaccucacaagugaggcaauccugucugcuucagucucucucucucucuuucaagauuuauuuauuuuauuuaugugaguacacuguagcugucuucagacacaccagaagagggugguggaucccauuacagaugguugugagccaccaugugguugcugggaauugaacucagguccucuggaagagcagugugcucuuaaccgcugagccaucuuuccagcucccugcuucagucucuagugcaggaaauauaggugugagccaccaucccagacuuauuuuuaaccuauggugcucuaguauucuaagugaaggguuguauauucauaauuauguagacuguguuauugaaaacaagcuaggcaauaaagcugcuuauuauuauugguguuugcgcugucaaaugaaucugaauguacuuaaaauuuuucuucugacugugccuuuuuaauucuaagugauagacgugugaaauaaaggaccauuaaguuguaacuaagcuuugguuaauaccaaacugaacuugauuugggaauagggguugggaugucuugagaaagguuuuugcuaauagagcuagguugagcuuaaacucaucccaguuguuugcucccacuucccaagcgggauacuacuagcaucugacaucacccaccccuaacccccaccccuggcugggggggggguagauagaggaaauauauucagauuuguuuauaauagaaucuuaaauuucaaaugcagauaagaggagaacaagcagcuaaugaaagagugggagguaaaauggguuuagagagaugggcagaggccagaucauguaguaugagaaauuccuugggcuuguucuuuuuguguguuuuuuguuuuguuuguuuguuuuauucuuuugggguuuucauuuuauuuuugagacagcauuucucuugucugucuggaaacuuguccuguagaccagacuggcuucuaacucacagagauccauuugccucugccucccaagucccggaaauccuuguuuuagcuucuuaggguuauagacaugagccaccaagccuugccuggcuuugguuguucugagguggaauaccuaucagguguuagauuuguugucuuguuuugaaguuggguaauaauaugaucugcaaaaaauuuuuugagagacagggucucauggaccuugggcugaccuaaaacuagcuauagagccaagaaugaccuuguuccucucaccucuacuucccugguucaggcauuacaggugugaguguaacaauuccuggcuuuuuguggugccuccccaucaucuguagcugcaguucuaggauaucugacaccuuuuggcuuccuugggcaccaagcaugcaagugguccacaguucuauauguaggcaaaauaucuguacauaugaaaacaucaaaacucuuacuaacuugacugguuuuacugcaugccuguuauuccagauuucagaauggcagaggcaggaggauuguuccaagguugaggccaucuucagcuagauauagaaaaaaaaaacaaaaccagcagaaaaaacccaacaagugauccagacuuguugcacaccuauaauccuagcucuugggaagugauggcagagaagggucaggauuuuaaguuggaggccacugagccauuucucuugucuccaagucuuuguguguauguguauaaguuuaugucguacauauuugugggcauucuuguggagucuagauugacguugggugucuuucuucauugcuuuccaccuuuuuuuuuuaaaacacuaaacaugcagcucaugacugagcuagacauacuggccaggaaguuucagggaucuuccuguggugcugagguuacagauguacuggugccaccaugcccaaguuuacaagugugguacagauccgaacucagguucuuucucaagcucacgaggcuguacugugagcucucaccagucugaguuuacuuuguuuccuuuuauuucuaagccaucaauuuacaaacagcugccuuucugauuuuaauuucuuuguuaagccuguauuaaaaagggaauaaauaauagggccugucuggccugucuuaggguuucuauugcugugaugaaacaagggaaccaaaagcaacuuggagagaagggucuguguggcuuuaacaucauaguccauugugggaaaccaaggcaggaacucaaacgagauaggaaccuagaggcaggagcugaugcagaggccauggaggagugcugauuacuggcuugcugggccuccuuucuuagagaacccaggaucaccagcccagagcuguacuguaccuuuccucaucgauaaaugucuaagcuugccuguagcugacucuuuugggagcaucuuccugcucuuugaugacucuagauugugucaaguugacauaaaacuaaccagcacacuugcuuauuauguaugaggcccugaauuggacuucagcaccucaauauuaacaaauaaaacuuuaaaaaagggaaaugcuauuugauaauauguuaaauagucuaggaaguaagauacaacgaucacuguaagucuucuagcuuaggugauuggagauuuauauaaugggacuggagagcugaucgguggguaaggcacauacugcucagugcccggcacccacauggcggcucacaaacauccauagcuacaacucacggagauaaccuccaagggcaccagacauauaugcagugcccauauguaaucucaggaaaacacuaauuuaguacauaaaaaaagaaauaaagauuuguauaacagagccaacaagauggcucaguaagguaaagaugucuauaccaccaagccugaccccugaaguuccaucccuaggagccacauguuggaauuucauagaaucaauucuuauuuccauacucugaccucuacaugcacuguagcauuugcuucugcacauuugcauguguauaugugugcacauacacaaaugaaugaauggggagauauauauauauauacacacacauauauauauauauauauauacauacacacugcacauacacaaaugaaugaauggggauauauauauauguauauauauauacacacacacacugugcacauacacaaaugaaugaauggggauauacacacacguguguguguguguguguguguguguguauauauaaauaaaauuuuggagucaaauguggagguucacuccuuuaauuccaaaacuuggaaggcaaagaaauuggaguucaagacuuuccuuguauauguagugaguuucuaggccaaccagggcuaugagagacucuguuuccaaaaagaaaggaaaagcauagcuuucaggcugguugagauaucucagcaaguaaagguacuuguuacaugagccugacaaucuguguuugauuccugagacccauaugaugcaaauuccccaaguuguccucugacuccucucaccacacaaaauaaauaaauguaaaguuuuucuuuuuuucuuucuuuuuuuuuuuuuuuuuuuuuuuuuucuuuuuuuugguuuuucgaaacaggguuucucuguauagcccuggcuguccuggaacucacuuuguagacuaggcuggccucgaacucagaagugugccugccucugccucccaagugcugggauuaaaggcgucaccaccacugcccagcaucugucuuacuuuuagaagacagcauuuauuguauuugaaaaguaagauugauuauguacauuuuuauuaugugaagaaguccaugacaacaucaguggacaugcuaauguggaagggggaaguuuguauggagggucacaaaacuacaggcaaaucaauaauggcugcucagaaaaauagucuuucuauuauugguuuuuccauugcagagugguuguaucuaaguauuugugcaguggaggggaggagugauguguaucuguuuuguugcugcuguuguuguuuugagacagguucucuguagaucuggcugaccuggaauccacaauguggaccaagcuagccuggaacucaagagaucuaccucccuuugcaucguccugagucugagauuuuagauguaugccacugugccaggcauguguguguauuuauauacauguauauuacuauagucauacauaugcagacacauauaaauacauauuuuuuuugugugugggaagguuucaagacaagguuucucuugguaauccuggcgguccaggaauucacucuguagaccaggcuggccucaaauucagagauccucccaccucuucugggauuaaagaugugugccaccaugccuagcuaaaaguuacuuucuuuuuacagaagaaggucauggugguauaaaugauaaauuuuucuaauguuaauaguuuuuaccuugauaacacuaaguugagcagaagcuccaguguauucaauauuugacuucaucucaccaccacagccaaggaaaguguugcuucuaaagguguaacgaccuuuauacuguuuugcaagaggcacuaaauauccucauugggaauucaugaagcuaccaaggcaaucuguacuugcaacuacuugugaugagucucugugaugagugugugugguggaagugguuugguguugagcaccaaaucaacuuuaaguugauaacaacagugacaaaaauccagaucugggaauagguagauucugcaaaauuguguguguguuggggggguagugaacacaacccauaaaacagcaguucucaaccugugggucauggccucuuuggcaaaccugucucaaaauauuuacauuaugccugggcgugguggcgcacgccuuuaaucccagcacucgggaggcagaggcaggcggauuucugaguucaaggccagccuggucuacagagugaguuccaggacagccagggcuauacagagaaacccugucucgaaaaaacaaaaacaacaacaaaaauuacauuaugauucaugaccauaguaagaguacaguuaugaaguagcaaggaagguaauuuggugcgcggggucaucgcggcgcgaggcacugggcugcauuacagcugaagcuuuagggccacaaggugcugaaagguuguagcugugucgugguuaaggauugugccaaagaaucucagguugaggauguaauugaauaguauuucaaaugcaguuaaauagugcuguacauuuuccugucuggauggacauuuacauucugucuuuauccuaauaaaaugaacuuauaucucuuauuuuucauagccuugcaucugagaaguuccagguacuuuguacaacugcaucccagaaccuguguguuuucagcaccuuuauaagguauguaaacaaauauuucuucuugcauuuccuuuuccucauauugagagauuaauacgaaaucuguggaaauaauuaagugauucucuuguucucugauuuugaaagccuuugaauuuuuccuguuguuuuguguaugcaugcaugugcacaugcuuguggagaugggguggggggcagcugugcaagucagcgcucugucugucacaugguaccagggauugaauuaaggccaucagcuguggcagcaaggaucuuuaucugaugagccaucuugccggccucguuuucuuuuacauuuguuuguuguuguuuuuaagauuuauuuauuuauuuuaugcauaugaguacaccaccauugcucucuucagauacaucagaagagggcaucaaacuccauuacagaugugagccaccaugugguugcugggaauugaacucaggaucucuggaagagcagucagugcucuuuaaccacugagccaucgcuccacccuuuuuuacauuuauugauauguguuuuggggagcaaugugguagucagaggacacauggaagaguuaauccuuuccuuccaucguguguuucuaggauuuaaauaggguagucagcuuugauagcagacaucuuaacccagacuccucacuaggccuggcacuuucuugacuuccuucccucccucccuuccuuccuuccuucccucccucccucccucccucccucccucccucccucccuccuuccuuccuuccuuccuuccuuccuuuuucuuuuaaaauuuauuuauuauguaugugaguacacuguaguugugcauaugguuguaagccuuuaugugauuguugggaauugaauuguuuuaggaccucugcucgcucugguuuacucuggucaacucuggucaaccccgcuugcuuaguccugcucgcucccgcccaaagauuuauuuauuauuauacauaaaguauacuguagcuguuuucagacacaucagaagcgggcaucagaucccauuacaggugguugugagccaccaugugguugcugggauuugaacucaggaccuucggaagagcagucagugcucgcucuugucaucuugccagccuuuuuuuuuuuuuuuuuuuuuuuuuuuuugcuucgagacaagguuucucuguguagcccuggcuguccuggaacucacucuguagaccaggcuggccucgaacucagaaauuuaccugccucugucucccgagugcugggauuaaaggccuuugccaccacgcgcagcuuguuucuguuuuucaagacaaaguuucuuuguguagccuuggcuguguagaacuagcucuguaagaccacacuggccaggaacucacaaagaucugccucugccucugccucugccucucugccucugccuccuguugcugcaauuaaagcacaugccaccaccaacuggcaacagauaaugcuaguuauguuaguggauucuggaaagaggugcaucaugagugugcgucugagagaagugccaggugcugcaggaaagcacuaaauggccugaucgcuggggaaugguggcgcacgccuuuaaucccagcacucgggaggcagaggcaggcagauuuaugaguucccgaacagccuggucuacagagugaguuccaggacagccagggcuacacagagaaacccuguuucgaaaaaccaaaauaaauaaauuaauagauaaauaaauggccugaucucaguugggagcugagggaugcccuugaaauacagguguaacccuaagccacaucuuugcacaucuuugcuuuaaaaaaaaaaaguggaugcuuuauuguuuuggcaaaaaguaguuaccaguuuuggguuuuagaauuccagaaauuaaugucuccagaacuuucgguuauuuucuuaucuguuaguacaguacucuacccagaauucaaccaaggugguuuuugcacugcuuacauugagacacacaggcagaucacugcuacacagaaaccaaagauucuuuaggauuuaacauuggagguuagagagacggcuuggcugcuaagagcauuuggugguuuucuagagcacugguucucaaccguccugaugacccuuuaauacaguuccuauguuguuguaaccuccaaacauaauugcuacuucauaacuauaauuuugcuauuguuaaugauuguaauauaaauaucugauaugcaagauauuugauaugugaucccaguguguauauaauguuauguccucuauauccagcgaaacuccucccacccccgcagcuggucaugaccuacagguugagaacugcuauccuagaggaaccaaauccaguuuuuagggcccaaccuucuucuauuaacuccaguuucaggguuccagugcccucuucuggccugugugggcaccagacaugcaaaguguuauacagacauguguaggcaaaacacccaaacacuuaaaauuaauaaaucuuuaagagaaauuaacacguaauaagacacagguuugaaaauuugaaagaaguauuuauauauaccaggcuaccaggcucuuuuuuccuucugagacccaggucuuucuguauagcccuggcuguccugggacucuguagaccagguugaccucaaacucacagagaucugucugccuaugccuccugagugccaagauuaaagguauacaccaccauaccuggcaaagucacaugauuuuuauuuguuaaauuuucuauuaaaauuuuuagguuuaauccuagaaggcuuagguagcuuuugcuuuucugauacucaucagcaucauacauauuuucaauuuagagagaaacccaagauguguaaauuucagcauaauuguuugagauaaagucuuagaauuauguacuuaaaguaaugucaugggauaaauguuauacccucaguguuuaaauguuauauccucuauaguaaaggauucauuucauuuuuucccccgcuccucauuucauauuuuugaaauucuaagguuuaaacccaaggcuuugcacauaugccagaggagagcucugcugcugaacuguaccccaacccacccaucaccaagcccuugacaaacgggauuguuuugcaguuagugucccagugucuagaagcgguagaaagcuugcuguaaccaucccuguuucuucugcauaauuagccuuuugaagaugcaugagguaaaaugauaauuaucuuaaguaugcugaauuagucauuuuuaaagcugugguuauuuuaucugcauggaaauuuauucauuaucuuucuaaaauauuacaaacaucuugauccugcagaggcauaguaacucagauuguuuccacuucugcuucuugguggaggacuguuuugagccuccugauaauuaauguuuggcuaauaagugucuuuagugcacuuacugcuaacuagcagcaucaccucagaugucuuuguuagcuucugguaugucaaaaggaagcuaagaauuauugaagaaauagauacauacacacuguaaugcuggaggcagaggcagagccuggccugcauaagcaaguuccaggacagcuggggcuauuacucaaagaaaccuugaaaaaccaaaaagagaggagagagggagaaagaauaugaucuauguagucucuaaaaagucaucaaaacuauccaguuuaguaauguagguuguagaagagucaggugcgauauaugccaguaugggguggggggagaguuaguaggucaaggccagccuuuacucccgugaaccaucucacugaugucuaugaucugacaaaggaaacugguacugaaagcacugaagaaagugagaaaguagggauuuaccuccuccucuaguggagcugacgagccagugcugcaaaugacugacauucuggucuccugccaccuuuguuuuuauaacugaaaucaguuucuaguaauugugccugaucuauguacaccuuaccuguuuaugccauugauguuuaacuuuauugaacagucaugugguagguguauguguucuugugggaaucaucucagaauuugaaaucugaaugaaauguuuggucaguagaguaauguauugcuuuggauagugacaauggaucagaguccaccuggaccucuuucuagaacuaaaauguguuagcugaucuaguccagaugugacuaggauuuguauuagagugaauaugaaguuucaucuucacccagauagaguaaauuauuaugauuaugacaagaucagcuguaggaacaguaacaugauuuccagcccuuuucucuuuugcguagaaaugcuuccuacaaugcaagaaagaaacguuauagggaaaacgauuugugugucuaaauuuccuuuuaagaaaaaugcccuauuugaguaacuaugauucucuucuaauuuaugaaaaaguauuugcaaccuuuagugcuuagcuguuaauaacaaguguguuuagucuuuuauagugaacuucauuaugguaaaaaccuguuuuuuagaauuuucuaaggguauaguaucucccccacccccauuuuuuaauuuaauuuuauuuauuuuuuauuuuuugacauaggguuucucuguguagcccugucuguccugaaacugauucuguagaccaggcuggccucgaucucagaaauccgagugccucugccucccaagugcugggauuaaaggcauuuaaaggcaugcaccaccacaugcccggcgcaugugugagcuacaucgcucucgagcgcucucucucucuccucccccucccuuccucccccccucucuuccccuuuuaaucccagcacuugggaggcagaggcagguggguuucugaguucaaggacagccugauguacagagugaguuccaggacagccagggcuacacagagaaacccugucuggaaaaaaaaaaaucaaucaaucaauacaaacaaaacaaaacaaaaacuaaucagcauaccuagggaggcuacauagaguuaaaacagcaguauacuccuaaagucugugguauagcuacaggucuuuacuucauaagcucccaccugcauccauccauuggacauucuucugcuggcaagaaauuccccaauagauuccagucugaaauccugaguuugucugccucuuuccagggucucaugucacuugaggucugugcguacaccuuggggcuggguuuccuggcacuucagaaugcugugauaaugaacagugcacacucuacucuuuauaaagacauugugugcuuuucccacaugaagacugugcaccaguaauuucaugcuaauggccacagcagggggaucagaaauuagaccuauuuaaggcuauuaguuuugggacagagcaguugaucaaagaauugaggaaauugguaaugacaucaauagcuguuuuuuuguucuuuaaagauuuauuucauuuauaugaguacacuuguagcugucuucagacacaccagaagagggcaucggaucccaauauagaugguugugagccaccauguaguugcugggaauugaacucaggaccucuggaagagcaagcagccagugcucuuaacugcugagccaucucuccagcccccaguaguugguuuuuaaaaacaaugcaaaguaagcuauuccccauccccaccccacccccuucucucucucucucucucucucucucucucucucucucucucucucacuuugagacaguaucucaugugugcuaccacacuagguuucuuuggugaggauugaaccaggggcauuguguguuagguagagucucugcuuggugagcuacaucucucagccugcucuucucuuaucuagcuuuuccaucuaucucucucuauauauacuuuuucauuuguauuuaucagcuaugguuaaagacaaugcuucacuuauucuguaccugcagcuucaugacauaaaaagaauauuaacuggucucauuuuggccuaauaacccuugacuucaagggugacccuuuuuccugcuuagcaguucuaagauugcuuaguguuuuuagaacagugaagcaucucuuucuagugcaaaccuguuuccuuucccagcaucacugccaacuguuacuugcuuuuuugagaaaaugaggaccagggcuguacucaguugaugguggucuuuauuaccagcagcuauguagucuaggcagaccuugaauuuugcuucuauuuccucaguguggagauuauagaugggaaccacuacgcugcuauuuauuuauuuaccugucuacuuauuuaguguuuguggguauguugccugguacucacagaagucaaaggagggcuuuauuucaccuggaacuggaguuauagacaacucugaguagccaugugggugcuuccaaccaaaucuugguccugugcaagagcaguaugugcccuuaauggcuaagucauuauucugacauacacacacucuggccccccacaccuucuuuuuaagaaauagugcuucauagagcgauugauugcuguguugccagggaugaacuucugcugcuccuagcuucaccucccaagccacugucauggcuaagguuacuguugcuggccaggcagugguggcgcacgccuuuaaucccagcacuugggagguaguggcagguggauuucugaggccagccuggucuacaaagugaguuccaggacagucagagcuauacaguuaaaacagaaucaaaacaaaacaaaaaagauguauuauuauggggcuggagagauggcucagggguuaagagcacugauugcucuuccgaagguccugaguucaauuuccggcaaccacaugguggcucacaaccauccguaaugagaucuggcgcccucuucuggagugccugaagacagcuacaguguacuuacauauaauaaauaaauaaaucuuuaaaaaaaaagauguauuauuauauguaaguucacuguagcugucuucagacacaccggaagagggcgucagaucucauuacggaugguugugagccaccaugugguuguaacuuuuauucuaaaguguuaaccauugcagugauugacagaacagagagagcuccuccugaugcaucaguaaagagcacuuugacccuuuacuucagcaaaggaagaagucuguuaauuaaggacauguggcuagaaccaaguccugccagucaaacucuauuagaaaaauccuucugggaugggcuagucuaucugaggccaggcuauguaaacuauacuaaaucucugagcucccuggguuucaccuggaaagucuaaaauaacuucagccuuggcaaugaauaugcuuucuauauauuuuccaauaggggagauaauauguaaagucagaauaaagaaugugguccucacugagcgugguggcccacacuuuuuuccgagacaagguuucuagcuguccuggaacuuuguagaccaggcggccuccaacucagaaaucuaccugccucugccucccgagugcugggacuaaaggcgugcgccaccaugcccgacuguggcccacacuuuuaaucucaucacucaggaggcagaagcaggcaggccuuugugaguuuaaugagaaccaagguucuuacacagaaaaacaaaccccuuacugucucaaagagagggggaaaaaagacaagaauguggucuuuuuagcugacuguuuuucuucauaauauuuucaagauucauccacauuguaucauguauuacuauuucauuacuguuaaugaugaauaauauuauuauauggcuauaucacauggauagcuuuuaauuguguauuaaagauuaauuuugagcuggcagugauggcaugcaccuguaaauccagcacuugaaagauaggagagccaggcuagguggugcaugcuucuaauuccacucuagagggaggcagaggcgggaagaucucugaugccagccugggcuacaagcagccaaggcuacauagaugaaaccugucuugaaaaacaaaacaaaaagggcagaaggaucaggaguucaaaguuauccuuagcuuuuuagaaauuuucaggcuaucuucaguuccauaagacucuuucucagacacacacacaaaaaacggagauuguuuuguuaauuaaaagcuaagggaaaaaaagauaaaaaguuuggcauauuagaaaguauggcauacuaaaguaaucauuagugucuuggggguaucugcuguucauuaaguuaguauuuucccuuuuuuauaaccuuaaaaaaaaaaagaugggcugggaaccuuuaauggaggcagagccugcagaucucugaauuccaggacagccaggacuacacagagaaacccuguccugaaaacccaagaugaggaggaggaagaggaagaggaguuguuguuaaaaaagauagguuucacuaugucuuuagguggcccagaacucacuguguagaccagguuugucccaaguacuagaaaaaaagcaccugccccuaacuccuggcuuuauuacauuuucuaaagguuaauagauacaaguuaauaauuucuuuuagucuuuuauuauuuuauauguggguguuuuccuuuaccacuugcaugcuugauaccuguagaggcccaagaaaggguauugggucccccagagcuggaguuguuauagaugguuacuaggagucaugugggugcuggcaauugaacccaggucaucuggaauagcagcuaaguguuuuuuuagcugcugagccaucucuccugugcugcuuuccgccccccccccccaacucuccucuccuucugccucaucucaugcaacaccacagauaaaccuuuauguuuucauacaaauguacuuucauaugucucauuacugagcgcuuacuuugaauucccaaucuagaagacucuagaagguguguacaaaacuaggcuaacuagcuggguguggugguacauaccuuuaaucccagcacucaggaggcagaagccagccuagucuaacccagcccagguuuucugauucuuuauuguuucacagguguguguguguuugauuuccguuuugcuaaauuuaauguuuucaggguccuucgagaaacagucauuacaaagccagcaguaaugguacauacuagcacuugagaauaaaggcagggagaccuaugucagccucuacuccauagugaauucuaggccagucuuggugaugagagaacacugaugauacauuauaaaggaguuagauauuuuaucaguguuacuucaaaacauguccuuccugugauuuugcuccuccuguguagcuauguauuauguucauuccaugcugacugcagcuagaaaauagacuuggaggaggaauagguauaugugcuaccuacagugaaagaacgugaaacuucaggaaugauucaagcccaaggaaagaugauucuugccuuccuuguguaggguaggucacaugggguauuuugggguuuuggaugguuuguuuguuuugagacagggucuacuguguagcucuggauguagaccagcuggccuuaaacucaaagagcuccaucugccucuaccuuccuggaguugggcuuaaaagcaucugcuacuuugcucagcuccaagaggaucccagugcuacauuuggaggcaacacccauuuaggagaauggugauuuagggccagaaacagauuuuggaacaaaagggaauacuugagaugaacaaguagggugcuucuuucugggaaaagaaaagguuuuugguaaagauauuucucugcacugagggaguuaggaauguucaaggcuaguuaguagauaagauaugugguucaaaaugugggagacuuagaagauccuaaaugcuagacauuuagcauugagaauacccagccauaggaacaggguaacuuuuguacuuguggggaaaauagggagcagaugaguguagguguuggugugcugugacuuucuuaaaacaacuuucaggagucuuuccuuccaucacugguacuagggguggagcucuggucagucauuaggcuugcaucucagcucuucuacucaaugagcaaugccguuggccuuuauaucugcucagaagaacuuaaggcaauagaaauagauaauuuauuaacaaaaaaggcauucccaagaacagaagugagcuaauaaacugaaaaaggacacauaauccaaagccuuguuuuuuauacaaagcagacggccacccuuguuuccauucccuguauguacuugaaaguuucuuuaugucugaugucuuaaccaccugcagcaagacaagacuauacuguuggucaaaaucaguggccuuaucuggccacuuguguguuguguauuuuaaaggcauguacacaucuuuauauuuuuuuguuuguuuugagacagucucacuauauguauccuuggccaaccaggaaguugcugcuuagaccaagacuggcuauauagagaucccccccauuucuaccucuuuugugugggggugggagggauugggaggcaguguuuaggaauugaccaguuuguccuucuaccaaguggguccugggcauugaacuugugucaucaugcuuggcagcaguaccacuuuccagaaaaugguaucagauuccuggaacugauaugagugcucagaauuaaacccaagguuuuugaaagaauagucaaugcuuggaccacugugccuucucuccagcccagcagcaaauagauuuuugcauuaagucaucgugcugccugauuuuuuuuuuuuugcgaugucucuguagcccuggcucuccuggauauucauucuauagaccaggcuggccuugaauuuagagagcuaccuguuaccucaggagggcuggggauuaaagguuuacaucaccacugcccagacuuuuuuuucaaauuuuauuuauuuauuuauuuauuuauuuugguuuuguaugguuuugaggucuagagauuaaacucauauguuugaaaaacgucaaauguucuaccacugagcuaucuaucacaucuccaguccuugaacauagacugcaguccagguuuaaaaucauacccagcuacgcuuugcaaaauuuauuuuugcuucuauuuuuuagaaacauacgccgggcagugguggcgcacgccuuuaaucccagcacuugggaggcagaggcagguggauuucugaguucgaggccagccuggucuacaaagugaguuccaggacagccagggcuauacagagaaacccugucucaaaaaacaaaaaacaaaaaaaaaaaaaaaaaaaaaaagaaacauacacacuauagcuucugcuggccaggaauggacgagguagcuccugcuggaaguuuaucccuucugccugggccuuccaaguacugagauaacaggcaugaaccaccaugucaggcuguaaacuuacucauuuuccagguuguucauugucaguuuauaaaaauacaauugcugucuuuugacagacuuucuaugcuggaaauuugaacucagauccuuuagccuaagcagcaagcccuuuacuaagccagccucuugaccgauuuauugguuuauuuugguuugguuuugguuuugguuuuugguuuuucgagacaggguuucucuguauaacccuggcuguccuggaacuuacucuauagaccaggcuggccucgaacucagaaagugcugggauuagaggcgugugccaccacgcccgacuuguuuuguuuuugagucucacuguguagcucuggcuagucuagaacuuacugugcacaucagacuggccucaaacucccguagaucugccuguuaccaugcucaaacgguaucccacauuauuacauuauuauucacucugaucauugugugugcuuuguuuuuguuuuuaaagauuuacuuauguaauguuauuaguacacuguagcugucuucagacacaccagcagagggcaucagaucucauuauagaugguugugagccaccaugugggugcugggaauugaacucaggaccucuggaagagcagucagugcucuuaaccgcugagccaucucuccagccccaauguguaccuccuuucuacccauauggcuacuaguaugugucauaaucugaggcuacuuauguauucuuaugcauuuuaaauaauaucuuuuguuuuauguuuaagugauggcugccaucaggaagaaacuggugauuguuggugauggagcuugugguaagacaugcuugcucauagucuucagcaaggaccaguucccagaggucuaugugcccacgguguuugaaaacuauguggcggauaucgagguggaugggaagcaggugaguacaagucccgcgagggagagucggugccauuguguguuggguacuguguacacagcgugaccaaaauguuagaaacagaaauccauuuucuuucuaccaccuuuuuugggggggauuuggacgaauugauugguugguacuuggauguugagacaacucaagcugguuuuuguuuuguuuuuguuuguuuguuuuuuguuuuuguuuuuugagagucaggguuucucuguacgguaguccuggcuguccuggaacucacucgguagaccaggcuggccuugaacucagaaaugcgccugccucugccucccaagugcugggacuaaaggcgugcaccaccacacccggcugauuuuuauaucauuguugaaccaaggcuggcuuugaacccaugauuuuucugggcuccaucuuguuuauuuuugaaucagggucuuauauauucaggauuuuccuuccaccacuuacuacauagauaauuacagguauauguaauagugcccagcuaguguaguggguuagacuagcugcucugcucuccagaguuucucauuauagagcacuuuuuugggcuaagaauacaaauaauguagggaauacaagcugggcauggugauucaugucugaaauccuacaguauaaauuccaggucagcuugaguuagagaguaagguuguccguuaaacucaacaaacaaguauguauguauauaggugaguaaacggcucucaggauauagcucaggauaguagugaccgccgcuauucagucuccagcaccacaugaaccagauguggugucacggguuucuaauccuaguaauggcagcaagagacaggaaaaccagacauuuaagguccuuuucagcuucucagcuacauaacaaguuugaggccagcccggagaacaugaggucuuauuacaguaaaguauaaagguauuccagacuagcauaagacauaguagcauacacacauaaucccagcacuuggcaggcagaguaaacccugccucggggaaagaaagaauauugguguagugauccagaccuguaguuagagcaacuuagaaacuuggagcagagagaucacaaguuaaaaugagcuugacaacuuggagaaaucucucagccuuagugcgcacgcgugcgcgcgcgcgcacacacacacacacacacacacacacacacacacacacacacucacacacagaggacugguuauguaccugaacacccuugggcuggggacauuggaaaccugcauauucuuugaaggugaccuaccuuugcagugucuugccacuucagucucaguauuugcauagaugcuuagauccaaguguuucuguggaccugauggggacugguuuuuacggaugucacauauaaaaccauagguggaaguuugcugaggucuuuuugaccuuugacuguugccaugauagccuucuugauugagauuugcauaucuauaacuauaauuuccuaaguuugggagucagcaguauuuccucuuugacauauuuucugagccuggauaucuuggauaaaccaggaucuugucuauaggaaauuuauugaugaaacugagaauguagcuuaguugguagaguuuuugccagagccugcaugaggcccuauauucucuucuagaauuucauaaaaacuagacacgggaagcacauaccuacagaguugccauuagcuacuccugaauuuggggacaaccuaauuuuccugcaaccaugucuagaaaagaaaaauagcaugcuuacuuaaaucuuugagcagggcaguaguggcgcacgccuuuaaucccagcacuugggaggcagaggcagguggguuucugaguucgaggucagccugaucuacagagugaguuccaggacagccagggcuacacagggaaacccugucucgaaaaaccaaaaucaaucaaucaaucaaucaaucagucagucaaucuuagaguaauaauccauaguuaucuuuccugugcuguuauucuugaacacagcuuaccaggaaagauaggagaguccuucauuuaagaagacaucucugaaauaagggaguuugaucugaaaaaggguauccauagguauugucuaccucagagcaauucaggagccaccgaaggagaaaaguuacuuagucuauuagucaaaguuugauuuucuuccuuggguggccuuuuguucucauaacauguuaaucuaauaaauacuuucauuauuuuuuugaaauuauuauauaguuaaccuuauuugcccuuccaacucuaucuaaaauagugguucucaaccuuccgaaugcugcaacccauuuucauugcuucuccauaccugcgauuuugcuucuguucaagaauugcaacauaaauauuugcugugcaggauauuugauauuugauaucugagaaaggaacuaacucguuugacugcucaaagccuuguacagguugaaaacuacugcucuaaaccucccaacaccccucucugcuuuucaaauucauggccucuuuuuuucaguguguguguguauguguauguuuccaaauauauaaguucaccgggcgcgguggcgcacgccuuuaaucccagcacucgggaggcagaggcaggugaauuucugaguucgaggccagccuggucuacagagugaguuccaggacagccagggcuacacagagaaacccugucucgaagcaaaaaaacaaauauauaaguucagccugcucagucuguggggcuucuacguauauuauauccaccugccucucuguucugccucccaaguaauuguugggaauuggcacuaguugguauacucuuuuauugggaaagacuguuuccccagcucucagcuguuugcccuuuaguucuuuguauaugcuuuuauaauaaacuauacugucuuauaaacuauagugucuuauaaacuauaaacauuuuuaauuguagcauuuugugcuguuuauaaauuugcuguuugauaaaaauuuuaaacaccuuguauuuggauuugauucucauaaaaaugaauagcuauuuuuacuauuugggaaagucugcacauguauaguaauauuaacauugugguuguuuuuccugucacagguagaguuggcuuuaugggacacagcuggacaggaagauuaugaccgccugcggccucucucuuauccagacaccgauguuauauugauguguuuuuccauugacagcccugauaguuuaggugaguagcccuacaggcugguuguuugucauuauucagauggaugacaucuaguauccuggauccuuucuggguaucaagugguucagauacauauauucugacacucagaaaaugagucaugccuggcugugcuggugcacaccuauaaucccagcccugggaggugaguucggggccagccuggacuacagagcaaguuccagggcagucaggcuacacaaagaaacccuguuuugaaaaauaaaaauagucuuuacaccaucuuuuugcacugucaccauggugacaucaagggcaucagcaaugcugagaagagaagagaggcaaacucuagguccugaucaggccauacuucagaguuauuguuugguuccuaacugugauaacaaaacaugguuacauuggugaauuagaggucauugaugauuacagaguuggggaaaucgaugugaaccucaaaggcagguugaauaaguaagugcagagcccuagauuugauauguaacucagagaccuagaaaaauggcagaaugguuacauuguacugacaaccuggcgucauggaccauggagaagcaagaugaaaacauaagugaggagaaauccuggguuuuuggguuugguuuuuuuguuuguuuguuugguuuuuugagacaggguuucccuguguagcccuggcuguccuagaacuuacucuguagaccaggcuggccucgaacucagaaucccugugcugggauuaaaggcaugcgccaccacaccccacuggguucuuuuuuccuaaagaucuaaaacuuaaaaagcccccuuagggggcuggagagauggcucagcagaaaagagcacugacugcucuuccaaggguccugaguucaaaucccagcaaccauauggugggucgcaaccaucuguaaugagaccuaacacucucuuuuggagugucugaagcuauuguguacuuagauguacuaaauaauaauuaaaaaaaaaaagccucccgggcuuugaaaauaaagaaaaacaaaaacugaaagggacaggagucaguggugcccagaguuucagagccugaguuuagaacaugggcuguggcuuccauuucauucuaggucucucuugacuuguauguguugggagugguugguuuguuuguuuauuguauaugagugcacuguagcugucuacagacacaccagaagagggcaucagauucuauuacagaugguugugagccaccaugugguugcugggaauugaaaagcucuccaacccaggaguguuaauuuuuuaaaauguucccauggugagggccagugagguggcucaauagguaaaggcgcucucaacgagccugaugcguaaauuuggucccucuugaaggaagaaacuguuuuaguggagccuacaguuaaagagacuuuuaauuguaaaaagacuuugaauuuuaagagauugaaauuuuaagaauauguaaagacugugggacuuuuaaaguuauuuagaucuuggggaugaauaagaauuugaucuuaugaguuguucucugcccuccacaggugagcuguagcaccugugugccaguccgugugcacagcaaugaacaaguaaagagugccucacacuuacagaauuaaaucuuagggcuuaaaacgugcucugccgucugggcagugauuuuagcacuugggaggcagaggcaggaggaucuuugaguuagaagccagccuguucuaaggacuaguuccaggacagccaaggcuacauuacauagagagacccugucuugaaaaacagaaauuaaguaaagguuagcuguaugggguugggccuaucuguaaucccagcauuugggaggcagaggcagaagaauuguuugaggccagucucaacuauacauuaauuuuugggcuagccagaacuacaugauaaaauccuuucucaaaagccgaugguggcgcaugccuuuaaucccagcacucgggaggcagaggcaggcggauuucuaaguuccauuacagauggaagaaaaaacguuuccuugcacauucuguuugucuuauuuuggcagccaagauuaaauauuagaaaacagaggaaaagauaugaaagacuuauucacuucacuaauaacuuugagaguaaccaaaagccuguuaaagucuaaaauuucacuuuaaauaagaaauuggcuugggagugggggcuugugccuuuaaucccagcacuugggaggcagagguaggaggauuucugaguucgaggacagccagggcuacacagagaaacccugucucaaaaaaaaaaaaaaacgaaaaaaagaagaaaaaaagaaaagaaaagaaauuguugagaaauagccccuguuacauccagauaauuacaccauaauaguuuaaauuuuaaagcuaauuuaaaaaucaagccauggaccuaagguggcagaggacuuaacuugccuagcuuacauugagaucccgagucagaagugaaagcaggaagaccagguagcucaggauugcccuugcccgugucguggucugaggcagucugggauccaugagacugcuucaagaaagaaucaucauugaacccagaucccuacucuaggcacagcucuaccacagagcuacaguuccgccuugaaacauuggaauccuuguacacaucucaaucccauugcuggcugaccuaugacaaucaauauugcuucguggaaccucugcugucucauuaauaguuggucuggaauauacauuguugagagugccuaggguuagaaaacuuguuauuuuaugaugcuaaaaauugaacuugggaccuuguaagcgccaaacaaguguuuuuccaagcauaucaacuccucucaagcauccauagaaagacuuaagagggcugaauagauggcucagcgguuaagagcgcugacugcucuucagaaggucgugaguucaaaucccagcaaccacaugauggcucacaaccauccauaaugagauccgaugcccucuucugggaugucugaagacagcuacaguguacuuacauguaauaaauaaauuuaaaaaaagaaagagagacagacagacagacagacagacugacuuaagagagccagguguuaguaacacaggacuggagcuagguguagacacuuuugaguucaggcuauccugaagugaggauuaagaccucacccccaaaagcacaccagggaacuguagugggcaugcuccugaucuuagccagcucuugggaagucaggaggagcugcaguuugagacaagccuagaccuugagacuguuucucuuuuacacaaagcaagagguuuuguaagcuuugggcaagagauuauccuguggaaccaagaacaagauaaagaauguaaccuuggggcgacuauaaccuuucuaccaccaaugacaggcauggccgguggugagcauucucucaguggaacagaaucuagagcucuucccacccuugagaaguucaacaauacuugaugggacagagagaggcuggugaccuucagugcuuguagaguggaaguuagauuuugccuucucuucucuucucucuuuaaaaacaaacaaacaaaaacccuggcuguccuagaacuuucucuguuaaccagacuggccuuaaacuuagagaucugccugcuucugccucccaagugcugagacuagaaguguacucuaccacuggcauugugcauuuuuuuugugauuuugaaaucaaugcacuuguuuucauuuuauagggccccaaauguuucuuuguuuuaaacagggugggugugggugugcgcacgcgugcgcacaugccacggugcacaugaaugucagaagacaccaagcaggagaccacucuuccucuaccacaugggucccagggcucaguccucaggcucagauucaagcaccuuuuaucugcugagcuguucugcuugucuccaaugugcuuuuugaaauaagaguggaaaaggaaaugccuuuaguucuucaaagugggauuaaaauguauccucaaauuuugugcauuuugucuuucagaaaacaucccagaaaaauggacuccagaagucaagcauuucuguccaaaugugcccaucauccugguugggaacaagaaggaccuucggaaugacgagcacacgagacgggaguuggccaaaaugaagcagguguguugugggggcaggaagagcgagaguuuacauacauacacauaagguuagacagccuuggcucuccugaaauaucaggugcucugauguuggggcuucuccuguaaaggagaaguuaaagucuuuaacauaaauucaaaaagaaauaaaaauuaaaaaaagaaagaaagaaauucagguuucccguacucaguguccaggacagacacuguuggcauucacagauuuaguccccuguaaagcuagguacaggcaggcaguccucuaccugaccuguugcucccuugucucuugcacugcacucaguaagcuauggacugggaguccaguucaguugcuugccuagcaccagggagggagggagggaggaugaauggauggguggauaauauauaucagcaccaucauagcaaaaaaggcugccucuggauuccuugcuuaaucuuccagaguuugucugaccucuucucucugcgugcaaaaggggcacaaguuuaauagacacaguaguucuaggguauucauuauaaguuugagaugcacuauucucaauugugggccaaguauggguugcuauaagucuuuuuuuuuuuuuuuucugguuuuuuaagacaggguuuuucuguguaguccuagcuguccuggaacucacuuuguagaccaggcuggccucgaacucagaaaugugccugccucugccucccgagugcugagauuaaaggcgugugccaccaccgccugguugguauaaagucucuuaaaccaggaguaguggcacuaucuguagucucagcugaugcucugcauaagagucauguugggacuggugaaauggcucagugguuaagagcacugacugcucuuccgaagguccugaguucaaaucccagcaaccacaugguggcucacaaccaucuguaaugagaucugacacccucuucuggugugucugaagacagcuacaguguacuuacauauaauaauaaauacauuaaaaacaaaaaaagaaccggaaaaaaaaagcaauguauuuaaaaaaaaaaaaagucaugcugacugugguagcaugugccuuuaaucccagcacucuugaguuccaggccagccugguuuauagaggaaguuccaggauagugagggcuacacagagaaacucuguuuagcaaaacaaaacagggcuggagaaauggcucagugguuaagagcacggucugcucuuccagagguccugaguucaaauccgggcaaucacaugguggcuuagagcauugguaaugggaucugaugccuucuuaugauuugucugaagauggcuacaguguauauguauaaauaaaauaaaucuuuuuuaaaaaagaaagaaaaagaaaacagaaaaggacaagaauuagcugaaaacacuuuuuucucuuuucuuguuuucuuuucucuucuuuuuuuuuuuuucuuuucuuuucaacuaggagccgguaaaaccugaagaaggcagagauauggcaaacaggauuggcgcuuuuggguacauggaguguucagcaaagaccaaagauggagugagagagguuuuugagauggccacgagagcugcucugcaagcuagacgugggaagaaaaagucugggugccucaucuugugaagccuugugaacgcagccucaugcgguuaauuugaagugcuguuuauuaaucuuaguguaugauuacuggccuuuucauuuaucuauaauuuaccuaagauuacaaaucagaagucaucuugcuaccaguauuuagaagccaaccacgauuauuaauaauguccaaccugucugaccagccaggguccuucugacacugcucuaacagcccucucugcacuccaccugacaccaggcgcuaauucaaagaauuucuuaacuucuugcuucuuucuagaaagagaaacaguugguaacuuuugugaauuaggcuguaacuacuuuauaacuaacauguccugccuacuuucugucaacugcaagaacucuggugagucacuacuucagagcuuuccuuguuaacagacuccauugccagagcucugggguggguauucaguuuuuugaaaucuugcucagccagaaaggcccaaguccacgcagcuguugcagaguuacaguucuguggucucauguuaguuaccuuauaguuacuguguaauuagugccacuuaauguauguuaccaaaaaauaaauauaucuaccccagacuagauguaguauuuuuuguauaauuggauuuccuaauacugauauuugucauucccacagaaaguguauugcuucuuuucuuuuucuuucuuucuuucuuuuuuucuuuuuuuuuuuuuuuuuuaagaaaguguauuuggaaauaaagucagauggaagaauucauuuuuaaaauucccauuuugucacuuucucugauaaaauauggccauaucccuuauucagcccuauauaucauucuaguaccccuuuccagacuggacuaaguaggaauuugguuucccgccugaggcaguuauacuuuggagguggcauagccuuucucaccuggacugcagggucuggcucuaagucacagugcuccuuucuccacacuguauccaaguugccucccagaggagccaccaguucuuauggguggcagugggugggggugggggggucucuucucuccagcugacuaaacauuuuucuguaccaguuaauuuuuccaacuaauagaauaaaggcaguuuucuaaauuucc

SEQ ID NO: 12165 - RNA, 44700 nt, Mus musculus
caguuuuaugaauagacuucuuuuaagggagagcuaaugaaaguuccacauagaaucacuuuaucaagggcagugggggacaaaacagaacuucuaggagucugugagaaacugaaaacaauagcccaauacuaacuucauuucauaaccgggaaggcggcuggaaaauucugagagaacaagagaauagaaacggguuucagagacaguuuagaaaacuauaagcccaucucaaugaacagcaaagaacuagaggacaacaucaaauuugcuggaggcuugguuuacuguggccagacuacuggggugagcagugugggcaccagaauccaaaacccaguucggagcagcccugcaggugggucuucauggcugcaccaugcucauugcagggucuuccucuccacucuuuggaauccaugagacacaugccacugugcaccaaaccccagcccacaauugagcuccacagguuuuucucucaccacccguuuaaaagaaaaaauaauccagccucuuaacauagagcccuucucagaaagcaggguuucucuuuccuuccucuucucauaaaaggagguaauguccucaucugguuugagauugauaugagcagucuucaagagugccacagauauucuccugggggaggaugcugguguugggaggguggcagggucacagaggccacaucaguugguguccauguuguaagccuccucaucccccaugcccuggugugagcugcucagcuucaccccuccaucagaaccggggaaacugccgagcgaagaugugcuggagcauucgucaucccgacgcugauagaacaacacguaggcggcuuucgucuaaaacacaaggaaugggguccauucacugauaauaaacucaccccaccccuuuccuagcaccugugaucccagcaaggcgaggggggccugacaggaggauucuuuuuccaaggucaaggccagccugggcuucagagugaaacccuaucuuaaaaaaaaaaaaaagcaaucuuaaacugaauguggggauggauaucuguaauaccggcacucaagaagcagagguaggagaauuacccuaaguuugaggcuacaaacuuacaaaaugaguuucagagcaggcagagauauagagauacuaucucaauaaacaagcacacucacugagugacugaguggacagcuguacucucgggaaccugccaccuuuauuuauuagcugcuuccugaugccccugccauggcucuagcaaaugcagauagaugcacugugauaccucuaggaaaacugagcuucuccguuaggaaagaucuaggaugaauggcaguccccucugcuccacucagagcccuagcagauaaggagguaaccgucuggcuugagggaaccuuuucgguugauuuguugagagcccagggaggagcaggcaccugggaaaguacucaccacuaucugguccucagaggccagggacacacugcuaucaucaaaguaauaccauuucccguucagucuguucuucgcauaugcagugucugccaaguuacaaacaaaaugcucuaauggccaccaaaaaaaaaauaaucuuguaaccuuauuagguuagcacuaaauacucgcacauacucauacccaaaauguuaacacuaaaacuaagaauaauguauacccaguguggauccacucaggaaccagagacagaaguacuacucccaaguucaaggccauccuggccaagucuagguagguugcacagugaaaccacaucucaaaacagaaaaccaccaccaccagauuauagaaauaauuuuuaaaauaugcacauacauauaaguaaugaucauuuauagucgauaauuuauaguucuuuuuauuucuuccccagagguuaggggauccaaacccagggccuuguacuugcuaggcacacacucugcugcuaaauaaauccccggccccuauggcucaugguuuuguacauuuuguuuguuuuuggcuuuucaaaacacaguuucucugugucccccggugguccuggaacucagagauccucugccucugccucccacagagauuaaaggcguguggcacugcagcccaguggaaauaauucaccauuuuuuccaaccugggucuuucagacaaacuugaaagggugagcacaggguguccuauaauuuugggaugcuaaucaauaaaaccagccuacuuaauguuaauauuuaaaauaauuuuaaauuuaauuuuuaaaaaagauuuauuuauuauauauaaguacaauauagcugucuucagacauuccagaaaagggagucagaucuuguuacagaugguugugagccaccauaugguugcugggauuugaacucgagaccuucggaagagcagucagugcucuuacccgcugagccaucucaccagcccuuaaauuuaauuuuaaaagcuguguguguguguguguguacacgugccaugguauuuguguguggagguuaacgcuguggggugaguucucucccucuacuuuuuuagaguucuuggaauugaacucaggucaccaggcuuguguggccaggaucuuuaccugcugagccaccuugucacgcuaguguguauuucugaaacucuguggaccacacuggcccugaacucagauccaccugcuucugccucccgagugcuggaauuaaccgcagaugccaccacacucagacuugucuauuuuuaaauaaagauuuauuauuugauuacauggaggguacugacaggugucacagaguuccaggcaguugugagccaccugaccuagguccugggaauuagcucagguccuguaaagaacagugauccacuacugagcuuucuccccagcugcccuggugucuauuuaaugacugugaucagugcuggagacauaacacaaggaaagggcaugcgccugagauuuucaucugaaucucuaacauagauggccacgaguauaauccagagccacagaaggacucagagagcugacgcugcuaaaauuaaaaaaaacaaaaccaaagcagaaggcuccacccccaucuccacagaacacccggugccuguggagccagcaggggcgcuuuggucaggaaggcagugcucccuggucugcagagcugggugugcacauuuucuucucuccacagcugugacugaaccucuggaguggauggggcugcaggugaagcuuggcggccacacuacuuaccuaggaugcacaaggcucuaagucccaucccagcacuggggagugaaacaaugccccuaaagcagguucagguguaacuaaaacacaguuuuagugaaccuaaauguuauagaaauucuggguaauagagaaaagaaaaaaacguacuauuuucccagauauggagauguguaccuguaucuuagcacuuaggugccuaggguggaaagaacguggguucaggaccaucgaggccuaccuagcaagucacaagccugccuggucuggaugugaggcucugucucaaaaccaaaccaaaaguaaacucauuuuggcaucucuccuucccuugcauuuucuccacguuuugguuuugcagcgcugcgauacuucugugauuacagucacuaauuuuguguaguugggugaauuauuagggacgucucuuuaacauuaacuuucuuuggaaacgguuaagaauucuuuucccgaguaccugaaccacagugccccgcucggaaacacuggucuacagagugagucccacgacagcugggguuacacagagaaacccugacuugaaaaaccaaaauaaacaaagagaacaauguuuugucauguccuggcucuaguagaguuuccagaguaacccagaguggcggcucacacugugccaggaaaguaaggccacccuggcugagcuacauggugagccccaggccagcauaagcgaucagcaggacugucuugaucguuaccaccacugaggaagguagggaggagagaggggcugggaaagcccaaagucggagacugaaaacaagccaggugcuacgucagggcuggcauccaggaagaggcugaggcacaguagguagggcguuuccauaccucagaaggaagcagaugccaauacuuacagugaccaacccccauggcuccauagugauuggacacagcaauuaggucauaaacauaaggccuugcugaccggucacagacaaacucggacauguucagagcucugagugaaaacauaauagcccauaaauaugguaaauucaaaaggucaguguaacccagcaccccccucaccccacagaacacuaaacuaugcgagaagacuaggccaaggcacagugaugguuugugggagcagaaacugggagaaggcugucauggugcuaucauaccaugagguugaagcgggguaaaagaugccaaagaggaauucagcaucugcacgcgaaggcugagacuaaccacagugcgaacaaggccauaggaauuuaaaugucagacaggcccuggaaaccuuuacuguauuuugaaauuuucuuuuguuaaguuucaaaccugaggcaagccacugacaugacugguaucuauugauuuuucauggucaaugcaagccucuaggucccuuuaguccuuucucaagggcccauuuaacccugaaaauugcacggcagucuagaauaaauguuuugccuguucacccagggaguggcuguugcggcuucuucccugugcccacggcagggucagggaagcucccagccucccuguggaccuuaacuaggauuaaaaguuuuauagggcuuuaauuuaaaaauuguaaauuuuaaggcuuaaccuaaauggauaaagcugcaaaauagugaccuuacauaaacuaacaguuaagaauaauuaagacaugcaaguucauggucagucaccuuauaaaugaucaaauucuuuaauguguucagaaguauacuuguaaucaugcuaaguacuacaguaauuauaggaauaagguuccugcauguuuucaaaguuaagcagaaaacaagugaccagagacagaguguguuuguuuagguacaguuaacaggugguccucaaacacuucagagaucugcagaauaugguauuuaaaauguuuaauaagaaaaguuuuucaugacagagagacaagucggcuccuagcauccucccaagaagauaaugggcacagaagaccauccccccaggcuuacucuaaaugcagcaaagcaggccacugggccaaacacugcccuucaccuugacuguucacagcaguguccaaacuguggacaagcaggucacugaggagucgacucccucuuugccuagacaaguaggccaguucccccaagcuccuacuguauaggaaagucugucagaccgucuaugccugguggcuacagagccaugccgcccuccacugaccacggaggagccuagggugaccuggaucucugucacuuuuuaaauagauuuggaagcugcuuggucuauacuuccugcuuacucaggugaaauuuaucuuucucaggucucuggugcugaccacaaggcucagggcagauuugucaguuuaacagcagcagccaaggcuucagcuguucucaguucucuucauguguacaaaauucaggccucaucuccuaagcuucuagcugagaaagacaguuuaccuugcugccagacucuaaaacgggguaaacucacagaauaggucucaaguaagcucuuccgcccuuucauguaaagagcccgcuuuacagugacuacugucaggacucaaccaccugugucucauagaaaguaacuggguaagaacaaauuauuucugggugcuuaagcuuuuauuaugacugcaagguaugagucugcugcucucucuaccauguggcucucaguacagauuacaaacagugguuaacacuaacauaccuaaaacaucacuuuuuauaaacuuaaaaaaauaauucuagccaggcgugguggcgcacgccuuuaaucccagcacucgggaggcagaggcaggcagauuucugaguucgaggccagccuggucuacaaagugagcuucaggacagccagggcuacacagagaaacccugucuugaaaaaaccaauaauaauaauaauaauaauaauaauaauaauaauaacaauucuuggaagcuucagggaaucgccuugaaucgaccucucacaggucaaauggacuccagauggacucagucaacagccuguuuccucaccugccugguccugagccugggaucucuccucucccccuuucccuggucuugggacuucccguucccaacuacuaggaccacgggccuaaaaguuucuaaugcacaccuaagaaaaaaauuuccccaaacuccuuagcuuuagcuucuacccuuaauauguaucugcuugagcagauuucuagucaauuaaaggcugcaaauugcuccaacugcuaacugcaugucccuagccccagaugauccuacagagacuggagagcaagaaccugcucuaaccugacuaggcuaucauuccaucauuuuguuuuuugguuuuugguuuuuuuuuuuuuuuuuuugguguuucgagacaggguuucucuguguagcccuggcuguccuggaacucacucuguggaccaggcuggccucgaacucagaaaucugccugccucuucaaaggaauaaggggagugacucaaucgugcauaauuacuuucugcugacauuagggaauuguuguugggggccaaaaaacuggauauguuagcauuaccucuguauucugcacugaaauccacacugcagaaagagcuggggacaaauuuuaggaguugguucucugcuucuacccugagucugggaacaaauccaggucagcaggcuugggggucaaggauucucaaugagcugccuagucucaccagcccauuauacaauuuucaaaaauaaagaaaagguaaaaaauaacagucaggcugaggcacaggcuucaaucccagcacucagggggcuaagacuggcacugaaugacagagugaguuccaggauugcccaggcugcacagagaaacucugucucaaaaaaccaaaacaaacaaacaaaaaaaguaaacaaaauuuuaacuacaaagguggccuuaaacucaaucaaugauccuccugcccgagcaaggaauuacaagcaugcgacaccacacccagcugaacaucagcucccgcggguaggcuaaccugguugccucgcccuguuaauaagaaacagaacugagccugugcuguccuggcugaagccaaguucccugacagcaaugacggccaggacaggccacagaccagugugaggauacaagcagaucagcagugacacaaucagcaggacucuucuaguagugacuuuucccacgaguaggggaaggaaggauugcuccacaagucacaagucaaccucccagagccaaguacuacaaucuaacuccagcaucuaucuucucaccucccuccucagcaccugugcacacacccaccugacugggaacuccaccacggugucaaguuuaucccgccaguaucuguuauaggagaaacgcuugaggugaaccaccaggaucuugggcaaagaccacaagucaaacuucuuuguugccugcuggugcuucuuacaggugggacaguaccuaaagacagaagagacuuacuuagccagggcagcaggaggucacaaggagaccuuccaggcaggacucaaccccaggacuuaugaacaaaccccugccuucucaucagagcaguggcuuuucucaguccagcaaacagucgucucucacacacaaauauuuacagaacugcuuaagaaaagaugaccuguccaggcacaggaggagguuucugugcacacagguggucccagcaaaccucagagccuaggguacauagguccccugcucagagcucggggacuugcauaccaggggucaugcuccccaagggucuccaugguggugaagagcucgaugcacucucgcagggcuacugccgccuucuucuucuucugcggcugugacaugcucaggugcuucucacaggccugcggagagaagcacugaguucugcugugaagccuccuggcggcucacgggaugcucaagcucugccuggaauauaccgugcuuucugcagucucugcacacagaauggcagucuugggugcuuuucauuucaagucauaaggaaaauuuaacuguuguccaaucaaugagaugaacaucaauguauuuucagagcagaagccagaacacagcacugaccacaaaccccaaaugacauaccucagauucuugcucaucaaaguaaaggcuucgggucucacugucccagucaauggccaguguggaucgagcuguggaggggaccauagugucacucauuauggaaugaccaacaccaggagaggcucuccaagugagaagggccacacucaggcagcagcaccacaccugcucacccaccaccagccacugaggagagcaaugcuagaaccuggggcagccuuuuugaaucucaaccucccacagcuucaaagucuccccuaauauuacagauaacccccaaaacccagaaucugacaggcggauuucugaguuugaggccagccuggucuacagagugaguuccaggacagccagagcuacacagagaaaccaugucucgaaaaacaaaacaaaacaacaaaauaaaaauguaaaugggaguguagauauggcucagagauuaagagcauuuucugcucuuauagaguacccaagcucagcucccuacacccacacaguggcucacaguagucuguaguucuaguuucuggggaucugacaaccucuccugggcucugugagcacgaggcaugcauguaguaagcuuacagacaggcagcaauaaaaacucagauaaaagacuguguaaagggaaccaggaacuacagugagugcuagagccucugccuuguaugugcaaguuccugaggucaguccuuagucuugauaaauacaugaaacauuuaaaaagcuggaggaggcuggaaagauggcuugacagcuaagugcccugucugcucuuccugaagacccagguucaauuaccagcacccaaaggcucuugauugucugaaauuccagucccgggggaucggaugcccucuucuggccucugcaggcacucauauggugcacacauauauauacauguaaaauacccauucacauaaaauuuuuuugaaagguauggguugggcuggaaagauggcucaguaguaagagaucauuuauuacucuuguagaacacuaggguucagucccuaacacccaaggcgggagcucauaauuuauuacagcuuuaguuccucugcaggucccaggcacacauaguacacauacauauaugcaggaaaacacucaaacacauagaaucuaauuuuuuuuuuaaagauuuauuuauguauuuacuuuaugugaguacacuguuguucccuucagacacaccagaagagggcauuggaucccauuacagaugguugugagccaccaugugguugcugguaauugaacucaagaccuucggaagagcagucagugcucuuaaccgcugagccaucucuccagccccagaaucuaauuuuuaaaauuaaagcuggguaaugguggcaggcaccuuuaauacccagcacuuggagggcagaggcauggaucucugugaauuugaggccagggauacagagaaacacugucucgaaaaaacaaaacaaaaaaaaauuuuuuuuaauuaaaaugaagggaagguaaaaaauuaaaaaaaaaaaaaaugaagggaaggaagggcaagggggggaggaggggaaggggaagggggggaaacuaacauaaguaguuaagguagaagacaaagggugcagcguccgcccugcccauggaggcaucgcacaugaugcauguccacaccccuagagaugcuuuuuccccaagcgcccaagcgcuguccugauuacaauccacaacuaccucuagcuucaucauauacaauuaaguauuuuuacggaacaaagagacaaaugcaccuauucuuaugagugaagcaagucuacagaaaugcuccuagcaugacccuaagaaucacugagccagaggaaagcucucgcagagcaauggaagccuguuugcuucugaggucaugaacaucaaggauuaaggugacagcugggcauaguggcauaugccugaaaucuaaagacucaagagauagagacaggaaggucagaaguucaaggccagcaucagcuacauaggaagucuggguuagaaccuccugggguuagagauggugaggaauacuucuugcucuuguagaguucaggucccagcauccacuuggugguucacagcaguaauuuccauuguaggagauuuaaugcugucuucugguguccacugauaccaggcacaaacauggugcacagacauacaaguagguaaaaugucaacacauaaaaauggggggggggggcgagcgugguggcgcacgccuuuaaucccagcacucgggaggcagaggcaggcgaauuucugaguucgaggccagccuggucuacaaagugagugccaggacagccagggcuacacagagaaacccugucucgaaaaacaaaaacaaaaacaaaaauggggggggggcuugucuuaaacuugccacucuacuaccgaagggaacaggguaaaacuccuuugagagauguguguccucaaccguucuccaaggcacucaaaugucugacccuagagcuacauaaagaguuaccaccugauguaggggauaugaaguaacacgauuccuaaagagcucuuaugugccccaagucuaccugaaggggcaagcaagcacuuacaguugaguuugaggaguuucccgucaguugccagugaauugauaucagcaguuccacaggaguucacgaggcugaagguaaagagccucuugugccucggcuggccuuucaccuuuugggcgcucucgcuauggucaucucccugaucguccucaccacugccuuccacuucggaaagcugcucuuuuccuuccucuugaugauccauuucuuccucuucaucuccugauacacaugaaaaacaaucugugaagucccauacuuagccagguauggugauaucuaucuauaacccaagcacucaggaggcugagaaaggacagugaguucaaggccagccacaaccacaugacaaguuugcagcuggucuggauuacaggagacccuaccucaaaacaacauaacccacaaagaaaccauaaaauauuuauuuacucuaaagugcauuauuauuuccuaguauauuuuguuguauauauauuuuuaaagauuuauuuauuuauuuauuauacauaaguacacuguagcugucuucagacaccccagaagagggcaucagaucucauuauggaugguugugagccaccaugugguugcugggauuugaacucaggaccuguggaagaacagucagugcucuuaacuguugagccaugucuccagccccuuugcuguauauauugaagugcauccaccccuauacaucuccauaguuauuagauacuugauuuaacaagugacugcccccaagaggcagacaaagcauguuauuccaugaugagguaccagauacccagagaaugaaugcauuuacuuuguuucucaagagagagguguuuguuuguuuguuuguuuguuuguuuuuaauagcccuggcugucuuggaauuuacuccauagaccaggcuggccuggaacucaagagauccaccugccucugccucccagugcugggauuaaaggugugcaccacuaccaccacuaccaccaccaccacuaccaccacuaccgcugccgccacgguugagaauuuaagugagucuuuuggcagcagccccucacaucacaugguucuccccuugacuucaucauuagcuucccagagagaugcacuaaaauggaacacucaguacccaagaacaguuuugcaaggaagaaaaucuuaaagucagauuuaaaaucuugcaaucucagugcuuggaaggacugggaaggaaagucaagcgaguguaaucugcacagugggcucuagcccagcccggguuagagcaagcaagcgagcguaaccugcacaguggguucuagcccagcccggguuagagagacaaagggagcauuaaagucaacagagaaaggcaugugcugcaugaguguggggaucugaguuugcuccccagaaccugcauaaaaacaaauggagagaacuaacuuccaaaacgucacccucggccuccacacacacccaugcauagacaaugcacacacggauacaagaguaauacacaaaaaacuuaaaaacccaaagaauucagagaugacuuauggauuuauaggaauaaaggcacaugaucaccuacacacugcagaccaggcacacuggccacaggaagggacggaggccuugggguuugcaaugaacccacugcacuguuuuucaacugugacuuucuucucuccuaugaccuaaacucaguuguuuccuaggaagucagaaauaaaugcccaagauagccagcuucaaccuccugauuagcuggccgggaaaccuguccuuuuagggcaguaaaggguccccagccaugcugaacgguguguacgaguccaugcuagggaaguaaaugcuaacagauaaggaggaaacucggacuccgggagcucgggaagggagcacagcaggcagugaccaugcaaggccuugaugaccagcacuguacaaucaaacagaucuuggcccugcuucauaaccuuagccucguuacccaguacuuccaggcucagugugucugagacagaacacaaugugugucagcaggaauccaaaaccauucuacaagauccaaagguuaauggugacuaagagauccuacacucuaccaguccagacucaaauaaauccauguguuuaacaccuuccaagaggagggaaaucaggagcaaugaggucaucacagccccacagccccacagcaggagugcuuaccuucauagcuacuccuagagccauugcaggccccaggcucuaagggugagcugagaaacucaucaggcaaaggcuguuuuauguagcggcuuaaaaaaaaaaaaagauuguuaguauuaacauuuaacucuuuuucuacaauacagcuaugaagcaguacguaauucacauauucagauauccauaagcauaauguaauggcucaagaaauuaagaaccaccuaagagaucacagguuaacuuacuaagucaauaaagauaccgagaaaggcugguuccaggucuucugggaaugucaugugcauuauuugauuugauugcaacaguguuuuaugguccccaggcuggccucuaauuugcuauauacuuaagggaaacuuucagcucccaauucgccugccuccacaucucacgugcuaagguuacaggagugcacugugaccaugccugguuuacggggcuguggagagucaacacagggguuugugcaugcuaggcaagcccucuucuccuccagcugaaugccauucagcacccuccauccuaagguaguugauaagauuacaugugccagcuacuccguccuguuagccucugccccccucugccccucucagggucuggcacaguuccuuuucucaaagcugaguacaugguaucaacagaaaaacaagugcaaaacccauucaucucagauaaccaugcgauuacauuuccaguaccaaccugauacgaucacaaacagccugguacaaagacucuaggguuagcuuaugcuuagggacagagacaagaaggggcuguccauagagcacagcccccgaggaagcacucgacggccuggacuucuucucucugaaguagacuggaagagugauacacucugagccauccauggacguguugcagaccucauaccugcaugagucacagagagggaaccuuuagcagcagguccgucagcaaaacagauaagcugcugcaaggugcugagcuuuuuaucuugacgacaaaagacagaguaccuuuuagaaagcaaaaggagauaagccauuuccaaggugauuacagguugagucaauaaucucaccaaggccgggcaaugguggcacacgccuuugaucccagcacuugggaggcagaggcagguggauuucugaguucgaggccagccuggucuacagagugaguucuaggacagccagggcuacacagagaaacccugucucgaaaaaacaaaaacaaaacaaaaaaaaucucaccaaggaucgcugucaauccaugugaaccuacagaacucagacaccggaccauacugcuuacucccaaagacauaaaccaugggccaucucugaucaucaaaggaaaugaggaccaucaucggcaccaucacggagaauucgucuaccaacuucacuuuuucucaccaaaaagcucaacuuuuaaaaguuauuuuuuaagucucugucucucuuccuccuuccuuccauaucccaggcaagucucaaacuuacaacauaacugaggaggaucuuaaacucgaauccuuccuccucugccuuccaagugcugggauuacagaccugguuuaucuggugagagggaccaaauucacuacuuuguauacacuaggcaagcaugcuaccaacuaagcuacauucacauuaaaaguguucaacacuaucacccagcuaggagcucaauuuuugaaacugaguuagccagacagugauggcaccuccuuuaaucccagcacuugggaggcagaggcaggcagauuucugaguuugaggccagccuggucuacagagugaguuccaggacagccagagcuacacagagaaacccugucuccaaaaaaaaacaaaaacaaacaacaacaacaacaaaaacccaacugaguucuuagugcucuucuguauaauaaagccaaauauaacacaggaauauacacugagacuacuagccagagccuuauuaaguggggaaacuuauaaaaccaguuacuuaccauuguuauucaagaaucacucaagcaaaauaaaauaauuauaccccacaccuucucauuuuuugaaaaguuuacuaugaagucugggcuggucaggaacuuguuauguuggccaggguggucucaaacucaccacagagccaccugucucugccucccaaaugccagacacagguacauaccaccacauccagccauauccaacuuuauaaaaauccagagaaaaccaaauaaacuacuagguacaaauaaauuauuuugaaaucugugucuuaaacagugaauaaacaguaccaaccugaucuaacgaggagggagguuuagagguagcauuugcuauucuggagauguuacuaaaauuacuggcaacugacugcagucuuucucucuaccuauagagacacacacacuuacugauuccaguuuguugagugcacaagcagcacuccuccucaaugccuggucagcaguuuucauuaggaaucacaaaggaaaaacaaaaauccuuuaaagauuuauuuuuauuggcauuuguguauaugccuucaugaguucuaugcaccauaaacaugagcauggagcccucaaaagccugaagacacgagauccccugacgcuggugauaaaggugacggugagcuuccugauacaggugcuagagcccgaagcugguccucuggaggauaaguacgcacaguaacuacugcccuaaaucccaaccuccaggagcagcuuuugugaaaacugcuuguguguguguguaugcgcgugugcgagcgcgcaaaugagaacugacaggcacaugucacacagcacagcgguggccaucacaggacaauuugaguggagcggguucucucccucuauguggguuggagagauuaaacucuagcaguuagacugucagcaaguagccauaccuauugagccaccuugcuggcuagugcaggagggauuuuaaaaacaacucauaagacacguuguaaagaaagacucaaguuagcaaugguuagcagcugggccucgagugaggcugcuccaaguuccagguucacuguguccuuuucagguuggagugacccaguggcacccucuaacuucuaggucuguguacuugguaggauuacucaccuaccaggguuguggugagcauuaaauuacaaggauagcauguaacauggcuaaaaauacuaucuguaccaagaagugaaguuucacaccuauacccagcacucaggaggcagagggacaugguucacucugaguuugaggccagccuggucuacaugguaaacuacaagacaacccugucucaaaacaauguaucaaccaaccaagaccaaacacuaugccacuauucucauaagacaauucauucuguguguggugcauguucguguagaggucaggucaacacuggcaucuuucucagucaacucuguuuucuuuuuuuuuuuuuuuuuuauuuuuuuuuauuuuauuauuauauguaaguacacuguagcugucuucagacacaccagaagagggagucagaucuuguuacggaugguugugagccaccaugugguugcugggauucgaacucuggaccuucggaagagcagucgggugcucuuacccacugagccaucucaccagccccucaacucuguuuucugagucagugucucucacugaaguuggagcucaccauuucagauaagcucgcuggccagcaagcccaucuccgccuccacagcaugggauuacagacaugcaccacuaggucuaccuuuuuacacaggugcugggaaucugaacucaagcccucgugugugugcgugugcgcgugcguguguguguuauaauauguguggaggucagaggacaacucuguagagucaguucucuccuuuuacuauguggauuggagggaccaaacuccuggaacuugcuuuguagaccaggcuggccuugaauacggagaucucccugccuuugccucccaaguguggggagguuaagaggcaguuaaaagcacuucuagccucaacuggccucaaauucagagagauccgaucugccuggcucugcugagaguacaaaacugagcaagccaacuggaugccguucugaaugggaaguaaaaaaagaguauacguaagacauggcuggcuggaagcugcaccucuguaccuaggaggaggacacacacccuauuucccaaagaguugccacaaaacaacacuuuguauuguuuccauggugauaagaaaacugaaaagcugaaucucauagcuuuauagaaugccugagaugccaacagccauucauucugagaugagagagugccaccaugguaccugcuugagaagcagaaaauggggcagagaaacccgaaaucccgguauaccacugcccuuugauugcccuggccuuucacacagcugugacucuuuguuuuucuuuuuuucuaagacaggguuucucuguguagcccuguuuguccuggaacucauucuguagaccaggcuugccuagaacucagagaucuuccugcuucucccuccugagugcuaggaucaaaggugugcgcaaccaccaacuggccagcugauucuuauugagcaagaaaccucugacagcagaaccacugaauuaguccucuuagcaaacagaaucuguugccaaagcuguguuagugcagggcucuguggggccaaaggguccuugguacuaacacauacccagauuccugaacacgcuucucuggccagguacuaggacguauauacagaaacaccuaagccagauacuaggacauauauacacaagcacugggucagcuacuaggacauauauacacaagcaccugggucagcuacuaggauauauauacacaagcaccuaggucagguacuaggacauauauacacaagcaccuaggucagguacuagaacauauacacacaaacaucuaugucagagcaaagucucuacagugcucuucugcucauguaucagaaacugcuaaguacuuacacaaaaaugucaucucgaggcgugauguggcuuaaaccuucauccauuuggaaaauuuuguggaagcggugauuauauacaucagugaccaccaucuaagaaucaagagcacaagcagaugacaggauggcucacagagcuccuguucacugacuaaaacugagaaacagcggcagaaacuccuugcucaaguguugccuaccaagaaccaccauucgaguggucccaaggcgacguauggccaagacggaaagggagcagcaggcuauugccagcacggcuguuugaugacauugccuucaaaugggaggaacgaugagaagggagugcugagcagacacuggucauggccuagaaaucccaguggcuuuccagagccagucucuauaccugcaccaugaugaaagcaagcccuacucuugucccucugacaaugggcggcaccaccacagugagagaaagacuguuucccugcacuggaaaggaccgugaguaagaccaggagcuaugagguauccaagacauuugcacuguccaauaacaaaaaucucccaaaacuuucagaguaaacccaaaggaccauaaagugauuugauggugggagggaccacuaaugacuccuucuuacauuuucugcagcaaugccagacagcuuggagagugcuucacacaggucagaaauggcccccaucaauggcacagucacacgguacugcaaaggagaaacagucaaggugacaggagacaagaaaugacccuagaggaagacacauccuggagacguaggauuccuccagaggcagugcauggcccagauauggccagcugacagagccaaggcucugcugucagcacagcugcaacacucaggcagccaccuccuucccucccaaauauugcuguauccuuuaccuucuggauugggucagcacuuccucuagagaaauguuaaaagcauauaaauugccauuuaauacuauguaucaccccucuuuccuuuuuuccccuugagacagcuucacuguguagcucuggauggcccgaaccucauuacaaagaccaagcuggcuucaacuucagaucuguucuaccugccuuugcuucccuugaggaccaggagaaaaagugggcacagccacacccagcagguaucaccuugcccucugcuaccagcagaauugcauaugaagacccacugaccauaccugacuuguucucccaccugucuggaagacaaacuuaaggaaacucuacugcauccucccaacauuccaggcccuuuagcaggaaaggcagguuacuacagcuacaugaauuuacacgguggggaagugacagagcuagccuaaggaccaucacaaguaaugagcuuacacagaggucucagagaggccaaggugcacauagagacuuaagcccaaggggaccuagggacagucaaugguguuucccaugcagcagauagaacguagucccaucugggaccagagucuacucagugaggggugcuaugaaggugaggauucggguaccuggauaggucugcacugagggucagcaggaaccaggaagaccuccauaauccgauccuucuucaaaggcagugggagaguuagauagcaaaaugggucaaaggucacagaaacuuuagcacauucugggcaaaccaaagucgauuugaaaaggccauggaaaguauccacaaucacagaaucauuccucagccugugguuuucccaggcuuccuuugcuaccaccuacacgaaaggaaaaggauuaaguagggagauucgcaacaucuguccucucccagugaacagccgagagcuuuuaguguaccguagucucaccacggguuagcucuacacccacaaccaucaagaaucuauggcaaaaaagggauucugagagcaccaaaggcacacaaguccaacuggggauugaccaauccuuuugugcuuuuaaugaucuaaagguccuuagggaagauuuuuguuuuggguuuuugagacaggguuucucgguguagcccgggcuguccuggaagcuacucuauagacuagguuggauuggaacucagaaauccaccugguucugccuccaaaauacugggauuaagggcaugggccaccacugccuagccuuaagggagauuuucuuuccuuuucuuuuaaagauuuauuuauuuauuguguauacagcauucugccugcaugauagaggagggcaccagaucuucauuauagacgguugugagccaccaugugguugcugggaauugaacucagauccucuggaagagcaggcagugcucuuaaccucuaaaccaucucucuaggccacuaguggagaguuuuuaauccaugauauaguuaagcuguuuuuuaagauuuaaaagcuacuuuaaagcauucaugucaauuguuuuaaugcaacaggaucgcuaaaauaaauuccccuuucaaguaccagagaaaucaaggcaucaaguauauaugucuuaaauuuaguuuuaaccagauauuuuaauaaucaaggaaagaagaggauacuuuaauacucuggaggcaaaagacucaaaauuucuaggcacucucagauauacagucagacaccagcccaaaguacuaaugagauccugucccacuaaaaacugggcuaguggcacaggccuguaacccuggcuacuugggaaguugaggcagaaagaugccaauuucaaggucuuccuaggcuagagucugaggucaagaccauucugagcaauguaguaagacugcauuucaaacuaaacaaugcaaguaggccauaacuucagcccagugguaugcacuuggccaauaggaagaaguuggagguuuuaucgccaguaccacaacuaaaccaacccuggcugagcuguaaagagcagugauagugguagagcacacggucagcugguaaguucucagugcucgcucaguccuggcuugccaaugcaauacuaaacaaacuaacucacuugaagaaacccgaggaagugcuaggaguuucuacagcuggccugggauguagcucagaaguugcaggccugucuagcacucaaacggcccugugaguuugaucuggagugcuggcgggaaaggcaacuauaguuagcgugcuuucugacuaggcaaccggggcccuugcacugacuccaaccccagaggucugugcccaugcugucaauacaagggacucucuuugggacagggugcugaccccuuuaguaucauaccgcaucuggucgcccauuggcguccuugggcuccagguaaggcuucuucuuuacgcgguucagguccucgugcaguccgucuagaauaaaggcuagcagcuccugggagucuugcuguugguagccagaaaacugaggggcaaaacgucccacuugcgucuacaacaaaagcaacuccauuaggagacacaauaaaguagugaagggggaaaagaagcaaacaaagucagggcagggcccacagcagcagccuuacagucaccugggcgacagucccgcuaacgccuuacaagcgacacugaggccaaugggacaccagaggaauggcucagguuagagguccaaguaaacuacaggccugaagucaggccacuauccuaacggggaggggcgcacucucagcgauagauccaagcagugaugugaaccccacuccagugucuuuuuguaguucgcagaguugaauuauagagccuuagaagugaucaauccaggagucauaugugaaacagcccuaacaucccuaggucugaguguccagugcugcuguauccagccgcccuuggaguguaguuuccgucagcagcacagcagcagugcucaaccacaaaccccaggaaugagcccauagucucuugugauaagucaagcaguguucuacaucugugguguguaauauuuuagcuacuaacuaugaaguuuuuuauauuuaaauuaguugaaaauaaaagagcagcugggauggagcucaccuccccuuucugagcaugcucaaaaccuuccuuuaagacccuaacgccuaggaguuguuuuuuuuuuuuuuuuuuuuuuuccuucugccucuaugguacccauggaagccagaagauaaauuugaauuuccugggacuggccuuacagaugauugugaccaccauguagaugcugggaauccaaucuagauccucuagaagaacagccaguucuuguaacuacagagccaucucuccaaucccuuuuccccuguucagauucuuggucacaguaaccaccuggcuagcggcuaccaccagacagugcagcuaucaacuguguccaucaguaugccgccccaaaaugccauuuguaagucguuuccacuugagcaaguccagggugcugccguccgaucuuaguauccuuuaggauuuaguguauaaaugguaauugacuuguaauucucacagauucaagugaccaagaaggugaaagaguccucacuauuaaccgaccacuuaagauuuuuuuuuccgcugagggaaaaaaucuaaguaagaauugccuuucacgggguuggagagauggcucagcgguuaagagcacugacuguucuuccagagguccucaguucaauccccagcaaccacacaguggcucacaaccaccuguaauaggauccgaugcccucuucuggugugucugaagagagccaaugguguacucauuuacauaaaauaaguaaaucuuaaaaaaaaaaaaaaaagaauugccuuuaacuagguaguggugcacgugccuuuaaucccaguacuaagaagacagaggcaaauggaucucugaacuagaggcaaggacagccaaggcuauacagaggaaacccuguuaugaaaagaauugccuuccauaucacccucugagaaugcaagucuaucccugccuucugagguccugacuagagcacagagacaugggacacaggauuccggauuacaucacuuuagcagucaaaaccaaacguuuaggggcugucaagaugguucgguggguaagagcacugacuguucuucaaaagguucugagaucaaaucccagcaaccacaugguggcucaaaaccaccuguaaugagaucugucacucucuucugguguugucugaagacagcuacaguauacuuauguauaauaauaaauaaauccuuaaaaaaaaaaaaaagcugggcgugguggcacaggccuuuaaucccagcacuugggaggcagaggcaggagguggauuucugaguucgaggccagccuagaacagagugaguucccggauagccagggcuacacagagaaaccgucucgaaaaaacaaaaaaaaaaacaaaaaacaaaacaaaacaaccaccaccaccaaaugcuuauagucuagucuagaucauagggcccaggugguagugcacacacuuugaucccaguauuugggaggcagaagcacauagaucucuugaauucgaggccagccuggucuacaaaaugagaccaggauagccagggauauacagagaaacccugucucgaaaaauaaaauaaacacacaaaacuguaguacugagucaggccugguagcacaugccuuuaaucccaguacucgagaggcaaaggcagcugcaucucuccgagucugagaacagccuggucuauauacuggguuccaugauagccaguacuacauaaugagacccugacucaaacaaaacccccacaccaccaaaaacaaaacaaaacaaacaaccaaaauaaaaauaaauaaauaaauaaaauaaaaagccccccacccaaaacuccgcagcacuaaaagaaagaaaaggacguucugauaacaugaacuuauuuuaagucuuagauuacaccuuuuuuuuuuuuuaaacaauaugagugcugagugucacugagugccacaguacagaacaugacagaggucagagaaaaacuucauagagccgauuauuucauucuaccguaacauggguucugggggcugugcuccggucauugggcuugccuuuacccacugagccaucuugcuggccccucagagucuacccucaccuaggucaaaaugcaagcaaagggaugccuuaguacaauaugaagccgcucccuuccaacacgcaggcucagcagauaaagaugcuuuaccaccaccaggccugaccggcugaguuugauccucaggauccacacgcuagagagacccauuccugcaaguuguccucugacaucuacacuugugcuaugcuacaugcaugugugcacaacugcauuccagugugcacacaaccuaccuugaacauccguggugccacgugagugucccuuccagaccacaucugcuugaugagcucugcauaggccucugcaaucuccccuuucauccccagaggguugucucgguugaucucggccucauacucaucuuugagaaaguacucagucaguggggcaguguugcucaggcacugaaacagaacaaagccagagcuugcaacccuuccagacagcaugaaaacaguuaauacagaccaaguccuuucugucugauacacuuacagaccaagcugguuucaaacucuuggccacccucccaccacagccuuccaaguccugggauuggagauauauagaagcauaccagaguucugcauuuggaauccuggacacucuauuugcauuuucucuugacuaccauuaaucuguauccuuuccucauuaaaaacaauuaucauaaauuaacuaucauaguuuuaaguaaauccuaaauccuucuagcaaaguauuaaaauugagagcuuucuuaggaaacccugaacuugcaguugacauuuuuagagacuaugaccuccuaauuuuggaguuggacucuuaaugccuugcagcccaugucuaucagauguuauuacauagugcuuacccaauaaauaugugaugaaugaauaaagagagauuucugagauagaucugccucugcagccuaagaucuuugaacuugagaucuuccugacucccacgcccugagaucacagucauaaacuaccaugcuaacacugguuucuguugggcucuguagcaguagugcuagggacugaauccagcauugaagaugccuaauaugcuugacagugccaagaaagaccucaaccaccccgagcccuucuugccuuuuuauuuuaagagaaaguaagagucugugucucaaaaaaauaucaaccaacuaacaaagcaauagauguuuuaggaccauaaacacugaugaugcuacucugaagcagccaguaggagauauccuagcagagacuucugaagcacuaaaaggaaguggggggagagggggcuaauacuaauuuuucaauuaacaaaccccaacaacaguuuuauucaguuggugaugcuccccucuaccugcagagcagaguucaugaagcaaguguuccccagguuuccaaguccacagaggccaggcuguauaugaggugaugggggcuccuggcaauuauacgaagcagagaagccagauccacugaaaaacacaacccacaucagcaauaaaaccaagugcugcacauauccccucaggacgacuuucagagcucugcuugggcauugagauuuugugccugguugucucauaauguacccuaccuucucugguccuccagagccaccccuccaucuuuacuugacuugucagcagguguaaguauaguggagaaaugcuauuuggauuuucuucuuuuagacuuuggcgacuaauuuuauaucauucuagaaggcuaucacaugauaacaggaaaacauauuuuagguaccaagaucaagagcuuacauuacaugugccaccauccacaaggccauacuacccuugacugggccugaguguucaucuacucuuuccuugcuuacucucuuccauccuguuuauaucucauggcaggugcuccuaacauucauagagaaaggaacacagcuacuaaaaggagaaacaggguucuacagaacugagaacugcccccuugcagcugccaucugaacagcccaucccuuuacaaauguuguaaucucccuacaccagcuaccaugccuucaagauuaucaauggcuuagacaggaaaaaacaccagacagcaaaaggacaagugagcagagucagaaggaugaggcaggaaugggcuggagcggaggccacaugcagcaugcucuugcaggcaguucuaaucccacagcuuuauuuuaggcacagaugagcagcccagguacccccugagaaaggacgcaguggaaggaaagcacaguuaaaggccuguucuuacccccugcugacaccggagcugugcaucccagagcuguuagugcuaucaccauuugcaaugagagaggcagacacugagcaauagggacuugcggaugguuuugaagagguagugaaauuucugcuaggugcagugcuugaucuggaaggggaagcaaaaaacaauacacugacuguuuuaaaaguacaggcccaauucacugcuuuaggucuugucucaaacauuccuaaaugugcuucauggcucacacuugaauccccagaaucaaaaagcuugaggacaaucuggccuauauggaaagaggaaaaagggaaggaaaaacauuccccacucucgguuaagcugcaaaagcgcugucuucacacuacgcaggagcuaugaaguagagcggagagaacuugucacgucugugggcccagcucuggucggucaucuaggguggcgugggcagcagcaaacuugagagagauucccaucugaaccuaggugggcugaccucugacgucaaccucgacuccacaagccugugucugcacuuacacacacgaacacacagucauccauucauucauccauucacauauauucuauguguguguguguccaucucgugugauggcucagcagguuaaguccuccccauucuaacuccuagagcuugauaauucucuccuucaauuuuuucuauauugcuuaugaaucggugggcacaaguacuuuuccuauugaucuccuuuccugacccaacaaacuguucacuuuauggcuguauccucaugcacaacaauaucugguacugcaccagagaucagagaaugcaccucacuccacucuaugcucacucuugaucaaccacaccacuccaagagacucuacccuucauggagucucaaggaggcacugcuacguuuucaaaagcugucucccuuagugaaaauucuuaggcuucagagugugggguggauagggagaaggaaaaccaagaagacagagguccaaaggccaggccagccagccugccucugccuggguuaccaccuguaccucccaggcuacaagcugagcaccuagaggguuuucucuagagcagugguucucaccauuccuaauggucacacucugacaggguuucucuguguagcccuggcuguuuuggaacucacucugcagaccaggcugguuucgaacucagaaaucccucugccucugccuuccaagugcugggauuaacagugugcaccaccacugccuggcaguguucacacccuuaucacaguuccucagucuggggugacccccaaccauaaaauuauuuucauuguacuucguaacuguaauuuugcuuguguuuucccauggucacaggcgaccccugugcaagcccuggaggauccacaggcuggaggcugcugucugcuuugugcacucuggugaagaggggggcaguccagcuugcacuugcccacuguuuccuacuguucuguuacaggugucacucagucaggggcuucagacaacccagcugaguucucauaaaagcauagaugugaaagucuaaggagggcugcagagaggcucccaugaccaagagcacuugcugcuucugcagaggacucagcauccauacgauuacaaccaccugcaacuccaggccagggaauccaauacccucuucuagcaccaggcacacacauaauacacagauauacauacaagcaaaaugcccauucacauauacaaaaaaaaaaaaaaacccaaaggaggucugaguucaagucaagaugucccaguuacaguucucagcagucccuagauccuuguagaggcguucguucccauguccuggcugagucaguaaagcuuuucucacacuugacugcuucgccucugcuucugauugcauaccuacuaugacucuccagcuucccucucaccuccagggagucucaugauuacaauggguccaccuggagagucucuugauuucaacauaauuaauuuaaucacaccugcaaagcagucuaaguucuguaauaaggacaaacauuuuguggcaauacaguguuuucuacuaaacuuuuguuuuguuuuguuuuguuuugcauaugcauagaugugggaaacgugcauguguguacacauacauguggaagcugagguucauguuaguugucuuccuucacugcucuucaccuucugaggcagaucucucugaauacagggugagaccauuucugcuaaauggcuggacagcuugcucuagagaucccugccuccagcuccugugcacuaggauuauaggcaggcuaucacacucacccaacacagugaguucugggaaugugaacucuggucuucaugcuugcauagcaagcaacugaccugcugaggcaucaucccagccacagguuugcuuuuguuuguuuguuuuguagauauggucuccuauauaucaggcuagccuagaauucacuaaguaccagaggguggccuugaacuccccuccuucuaccugccacacagguaugcgccacuacagcuggcucuguuugucaucaggucaggaaacacucauguuauuucccugcacuacauccuagagaaaagccaucacuuucuacugcaaggugcacaauuccacaagccacaugaauaucuccuggcauaacugugcuuggaauccaaauuuaguagcugagcuguaaucuguaagaggccacagaaaagucgaguaggagcaagcuaucacccuuacgucguccaagaccucacccuaauccuccuuccuuucucaaagccucuaaacuacaaguagaaaaauaaaggagcuuaacacacacacacacacacacacacacacacacacacacagagccacaauaucagaucccuccccaucucuuguccugacggaaucccgacagcuauuucgugcaugaaugucaagcaggcugcuuaaaaacuggggcuuuggaaugagaaaccggcuuuccaccuacuucagaacaagccuucccucuucccuuccucugcaccuaugagccagguacaugggggagaagacucacuuacuuugacugcaggcucugccggggccaugugccaucuucauuuuggggcucaauuacuagcaccugagugaaaggggaaaccagaugagcacaaugcaacaaacccuacugcugacaugcuuacugccagaagccuucaugacacacaccccagucagaguugccugucugggcauggguugggcccgcuuaccugacccugguacagcccagcauccuggauaguguugucuagcuugcucaacugcucauagguguugcucauguauuuguuccaaagccguguuucacguucugcagggauguugaagagcuuccucaucuccuucucaauaguugcuaagaacaggcaaaaacaucacucaggauugucuccagaaauaaaguuaaagaaacccuagaauucacuaauaccagaggguggccuugaacucccccuccuucuacugccacacaggcaugcgccacuacagcuggcucuguuugucaucaggucaggaaaaacucauguuaaggcaagcuggguagugguggugcucaccuuuaaucccagcacuugggaggcagaggcaggcagauuucugaguucuaggccaaccuggucuacagagugaguuccaggacagccagggcuacacagagaaacccugacucaaaaaaacaaacaaaaaaaaaaagaggaagggaagaagaaagaugaaaagauaaagaaagaaaaguaacauaaaaguuagaaaacuggaagcuaggucgugguggcacacaacuuucugucucagaaaacaaacaagaagagaagcuuguucuaugaucauuacuguuagacaaacacacacacacacacacaaccuucugaguuuauuucaccaauuuuagauggagugggcgaggccacaggagagaucugagagagcaggggagggguggaguaaggagagagaaggggagugauguaauaaaguuuuaaggaagaaaaagugaccucggagccaggauacauacagcccagcccaugguuuagcaauggauuugaugaugcacaggaucaugaguuugaggucaucugagcuacacagcaaggcuucaucucaaagaaagugggugcuaggcagaguggacagaggaugugguuuaguguagagcccuugcucagcaugagugaaagguccugagauugacccccagcuccccaaaacaacaaccaacccaaacagaaucagccauucuccccugagauuguuaggguuucuuuuuuuuaauuaauuuuuauauguauaaaugcguuuuugacuguauguauguuuguacacuaaauguguuugauacccucaagaggccagaggcuguggguccaugggacuggaguuaaagagaguguggugguuugaaugacaauggcccccauagguucaugucuuugaauguguggcucccagguagaggaaccguuuggaaggauuaggaaguguggccuguuggagaaggggaucccugggaggcuucgaaagcccucacuaggccuugugcugcucaugcucucuccuccucuccgaggucaguauggaaagccugcagaucaguaugaaaauacuguugcagcaccacgccaguguguuuccugccaugacgcucgcucagggacuaauccucuaaaacuguaagcaagcccccaaugaaauguuuucuuuuauaaguguugccuuggucuuggugucucuucacaggaauuaaacaguaacuaaggcaauuguaaacugccacguagauacuacaaauucagucuaacuccucuggaagaauaaccagugcucuuaaucacugaaccaucucuccagccacuguuaugucuucuguguaugguaugugauuuguuagugcugguauaugcauaagcaugugugugggugggugucauuguggggaccagaggccauauuuagguaucuuuccaucccuucccaucuuuuauuuucugagacaggaucucucugugaaucuaaaaguucauugauuuaccugggaguggugaccaaugagcuucaggaaucuaccugcuugucucacguuccccaguacuaagguuuaagauacauaccacaccuggauuuccuauaugguagggaucugaacucaauuccucaugcccgaacagcgggcccuuaccuguuaaaccaucuuccuagccuuuccuuuuuuuccucuuugaaauaggcucucacacuggccuuaaacucuuggcagauccucaugccucugcacuccaagugcugggauuacagguguuagacaccaugcccaauucaaguaguaaaggcuuuuauugguuuuguuugguuuuuguucugagaccaugagugcgaucccuaggaucauauaaaccaggcacuuaggagguggagacagggagaucaggaauacaagguuaugcaugacuuuauacagaguucaggccugcuugagcuacuuugcuggccauuuugcuugcccaaguacuguucuauagaacacaguucccaggucugguuccucauaaacauucccucacgaagacuuccaagucaggacugaagaccacagaugaguaacaauagugaaagaaaacaacacagguucccucucaucaacuacaauacccuguauacuuucaccagacaugcagaacccugccagcugcuuaccaauggugucugcuuugcuaaaauggcaacuuagcacauugguggggucacuguucucacagagcuucagcuccagcaaauacacuuccacuuugcagugcuugacaaacaggccaugcuccacaaccuguaagcaagagaggcaaaggugaaggagcggugguggacaucuggacaguccuggaagcaacauggcucagcaccagaaggcuaaagagaaagaacccaggagaaagaaccuucugucaggaauuguuuguuucugagauaaggucucacuauguagacuggcuuggaacucacuauguagacuaaacuggucuugaaaucaaagaacucuaccucuucugagugcaagaauuaaaggaaauguauccccuacauuugaucuaagaaaaacuaauuuuuauucaauuuuacaaaguauagacugaauagccaggcagugauggcacacaccuuugauccuagcacuugggaggcagaggcagguggauuucugaguucgaggacagccuggucuacagagugaguuccaggacagccagggcuacacagagaaacccugucucgaaaaaaccaaaaaaaaaaaaaaguauagacugauuuuaucagcauauaucccagaaguuacaauuuuuccuacuauaaugaagaaccaaguauaucuucagggaaccacagagagaucuguguggauaaaccagcccuauaagacaugucucagaaggucagcuuugaacagaaaacucuugcuuuggcccuuacagagucugucaaaccacagcagaauguuuacacucuacacugacagcauuugcagaccucugaagaaggcuguacgcccacaaugcugauuccuuagcacucuuaaggguuucaaacugucaaaaaaacaaaaacaaaaacaaagaguucuaaagccuugcauggugacacaagacuaauuucaacucaagguauauugaggcagaaggauaaagaguucaaggucggccugaacuauacaguaacuuuaaagccauccuagacuacaugaaacaguuuuuuuaaaagggagcagguggguugguagucauggugguucugauuugaaauaaugacuccuuaagaacacagcucuuguuucuucuucuucgggaaaacaccaaaugguggaugacgccggugcagcgagagggcccggaggacccggggcccaggauuaggaggccgcgguggcuuccgcggaggauucggcagcggucuuaggggccguggucauggccgaggccguggucaaggccccggggcucguggagguaaagcugaagacaaggaguggauccccgucaccaagcugggccgccugguuaaggacaugaagaucaaguccuuggaggagaucuaccuguucuuccugccuauuaaggagucugagaucauugacuucuuccugggugcgucccuaaaggaugagguucugaaaaucaugccagugcagaagcagacucaggcuggccagcggaccagguucaaggcuuucgucacuauuggggacacaacggucacguuggucuugguguuaagugcuccaaggagguugccacugccauccgaggggccaucaucuuggccaagcuuuccauugucccuaugaggagaggcuacugggggaacaagauuggcaagccccacacuguuccaugcaaugugacaggcugcuguggcucugugcuggugcaucucaucccugcccccacaggcacuggcauugucucugcuccugugcccaagaagcuccugaugauggccgguauagaugacugcuacacuucagccagaggcugcgcugccacccugggcaacuuugcuaaggccaccuuugaugccaucuccaagacuuacagcuaccugacccccgaccucuggaaagagacugucuucaccaagucuccuuaucaggaauucacugaucaucuugugaaaacccacaccagagucucuguucagaggacccaggcuccagcuguggcuaccacauaaggguuuuuauacaagaaaaauaaaagaauuaagucugcuuaaaaaaaaaaaaaaugcagcucuuaccagacaguggugccccacaacuuuaaucccaguccucaggaggcagaggcagguggauccugaauuugagguuagccugguuuauacacugaauuucaggacagccaggauuauacagagaaacucugucuugaaaaauaagcaaagcagagagagagagagagagagagacagacagacagacagacagacagacaaggaugaagcucugucauacugaggagagcauaccccccaagcaacauggaaauguauguauugucuauguaucagcaguccugaaugggcuuuuaugauuccuuucuaguaagaaaagcuaguagcugagagacaaggcagugaucucauguguucuguccaccaaaggcacaaagcugugugucucagugugagaacuugagaaguucuccuaugcauauaaacaccuacguuuuuacuacucagcaguacaaucagacucaugagcacaggggaaauggcuuuagaaaaguuguuagagggcuggagagauggcucagugguuaagagcacugacuucuuccagagguccugaauucaaaucccagcaaccacaugguggcucacaaccauccauaaugagaucugccgcccucuucuggagugccugaagacaacaacaguguacuuuaauaaauaaauaaaucuaaaaagaaagaaagaaagaaagaaagaaagaaagaaagaaagaaagaaaagaaaagaaaagaaaagaaaagaaaagaaaagaaaagaaaagaaaagaaaaagaaaaagaaaaagagaaguuguuagguaagcaugguggcucacacuaguuaucucaacauccaggagccucaaugaaaaggcucaaaauggucaaaguucuaggccuacuugagcuauaagugaguucaaauuuggccugguuaacucaguacaacaccaucucaaagaaaaaaaaaagagggcuggauauagcucagugcuaggacacucagugagucauguauucuauucggcccuagguucacucccaguccuggggaaaaggaagcggugcaaggugcaaugcauucgauuauguccacacagcccaacugaagagcuggguuccaaguacuaugggcauuccaaaccagcaggcagcucuuguauuuggaggccacuuaggaacauccugaguuacucacaaauacuucauaucccagagagaaguagaauagucauucaggccaaaauuccagcauacaagaggcaggagaugaccagaacaagaccagcccgggauacacagagauccugucucaggaaacauaaacaaggucuaaagccugguacaucuuuaaucucaguacuuagggaucucugaguuugaggcugguuugggcuacauagaaaguuccagaacuacuuacuaguaagggauacucagaaaaacccuguuucaaaaacaaaaacaaaccaaaauccaaaaacauuacaaagucucaccugcuucauuuucaaccauguaaccguuuucauccucccgggaaauaaagagaagucaguguacccaaggagaacucacauacacaccuagcaggucuaacaacuugucaacucacuuuucugacaauaggcugcuggcccuccacacagccauaccaauucagcaauuuauuccaggcuucggcugggaccagcacauaguccagcucaucgauuaagugcuccuucaaggucugacucucaggaucugaaaaaggaaaucagggcagaucucauuuuucuuuuccccagaaguuucuuuuuguuugguugcuuguuuuuugaaacaagauucuuauguauuuuucauaagaaaagauucaacaggaacaagcacaauauuccaaaacacugucacuggcuacaaaacaaagcagaccugcccacucuuuauccugagucuuguucuaugaggaacuuguaucucuucuauaaugagagaaaagugagcuggaguccgugguucauccucauagucuccacuacgcaggaagcugaggaggaauagguuaagccccgaaguucaaggucagcuugggcaacacagcuagacuccaugucaaaaagaacaaggaggaaggauggagaggaaaggagccucucuguucauuuucuucuucugaagucaaauguauugaaggugaacaugguggugcacccuuuaaucugaggacuugggaggcagugguagguggauuuuugugaauuuagagucagccuggucuauguaggagcuccaggacagccaaggauauauagggguaaaaaguaauucuaaaauaaaauuuauugagcuauauuuuagccauauuuuuugccuuuccccaagcccucccaaauccccugcccuacuugcccccuucucauuuuugucgucuguuuugagggucacaugcaguacagcgugaccuugaauucuacacagccaaagaugaccuuuaauuucugaucuuccugccuccacugcagagaugacaggaaggagacuggagggaaaaugagccggggagauggcucagcagguaaagguacuugcugccaaauccaugaacuugaguucaauaagaauagguuuuuguuuggcuuuguuuuucaagacaggguuucucuguguagcccuggcuguccugaagaagagaguacaauggcuaauaauuauaaauacuuauaauagcaauccuauugauagugcuugaacucagaccccaucuacacaugaaacauuuacuaagaaggcaaaugaaugaggugcugagggcugggaggggggugagggguggggguggguaggguauuuucuucccaagcaaccaugcccacagcccucaguucaauucccagcaaccucaugguggcucacaaccaucuguaaugggauuugauucccucuucuggugugucugaagacagcuucaguguacucauauacauaaaacaaauaaccuuuaaaaaaaaaaaagaguucucauggacacuguguggaauggaaaguaaauauguaacauguugaacaugcauuuuacacccaucacaaagguauaugaaacacucagcggaaaauccaacaagauucaucaccugucagccacaaaguguacucccugcuaagccuguuuaucaacacccacacugaggaugacagaagucacugaucucagaccaguguagacaagaaaguacccgugaaggugcaacucagcuguaacccaaggcagaugauuuuuuuuuuuuuuuaaauagaaaccaggugugauagcacacacacuugauuccugcacucagaagguagaggcuggugcaucccugucgaguuccagaccagccaggucuauauuguaacaucuugucucaagaagaaaaagccgggcaugguggcgcacgccuuuaaucccagaacucgggaggcagaggcaggcggauuucugaguuggcggccagccuggucuacagagugaguuccaggacagccagagcuacacagagaaaccccgucucgaaaaaccaaaaaaaaaaaagaaaaaaaaaggagaagaugacaggcauggugguaguauacaucuguuaacccugugccuagcagacgggacaggaggaccaggugcugcuagggugucagcuacagaaggaguuugaggacugggaacaaggagguuggaggugacucuccugaagcgcugucucugacugucucuggucugaagucaguacagagaugcuugauguagaccuacagucugaccuacuucacguguacccggccuagccuacgucaggcuucaaagcaaaaccuaaaaaacuguccaauucaguagacagguggaaauaagaagggcugcucugcaggugacaggccuguuuccugcugaauacaucugucaagcagucauucccacaccaugaugcucagaccuagaaccccacaggcucuggaaggcugaaauagacuggucaauucucaggccagcacaggcaguagagagaaacucucaaccaacaccaccagcaccagcaccagcaccaccccuuccccuccaccaacacacugccacugucaccaugaaacaacaaauaagaaaacaaaaaauguuccucuuaaccagacauuaugggggacauuugcaaucccagcacuauaguuagaaagacuauaaauucaagacuuaacugggguauacauguaguucuggaccagguugagcuacaaacuugcuauguauccaaguuguauaccaagacccugccucaaaauaaguacguuaacaaauagaauuaucuuccugagcaucugggaaguaaauucaagaaguacaugaguucaaggucaaccucagcuacauuguaguuuaaggccagccugaaugauacaagaucacaccucaaaacaaaagaagcaaauaaaaacuccaaacaaguaaaaauaaaaauaaacaggccaguagguagagcauagggcauggcuuuaaucucagcacugaggaggcagaaguaggaggaccucugugaguuaaaggccaacccggucuacauagugagaccauaucuaaaauaaaauuaaacccaucauggaauagccaugccuggcagcaggucccugugagccuagcacuugaaacaaagagcaacacaaauugaggccaaccccagauccuuaacucagauccuguguugaaaaaaacaagggcuggugaggcagcucagcagguaaugacaccugcuaccaagcagaaccacaugagugugauccccagaacccacacugcagaagagacagagacguuguccuuaaauccacacccuggaccacgccaugcacacaagcacucacccugucucacacacaaacagauacauuuuuaaccuagaaaaauguaagauuaauaaaaaccugaaagccagacucaauggcacaagacuuuaauuucauaacuugggaggcuaagacaggaaggcagugauuucaaugucagcuuacgcuacauagcaaguuugaaggaacacagcaaaacucuaucuguaaaauaaagcaagaguauaguuguaguggcacacuccugaaacuccaacacaaaggaggcaacugcaggaggauuaacucaacugcaaggccagccagggcaacacggggaagacacugccugagcaaaauccaacagaaauggagggagcuggagaaacggcuccacagguagcggcauuuacugccaagccugaggacaugaguuggucccuagaugauggaucccacaggguaagaggaaagaaacaccuuccaucagcagcacucugaccuccacaugcacaccacauaaacaccagagaacacucaugagcacacucgcacacacacaggaauauauuaaguguaugaauacacgccugccugccugccugccugccugccugccugccucuggcagauucuggacacagguacaggagugagcauuuggggaagcugaccucacagucacaggauccaucauccaucacuucugcugacacacuuaacaggacagcgccgaggucagaagccacaacucuacugaccuucuaccucuccuuacgcuauuccuacuauaaacagucgguacagagaggccugaugacguuuaauaugcaugcaauuuguccuacuucacagguaucaacauuuuguggguacagcuaaguguaguggcacacaccuuuaaucccagcacuggggaggcagaggcaggcagaucucuguguguucaagggcagccuggucuauauacuuagugcuagggcauucagggcuaugcagagagacccucuucuugaaaacaaaaucaaaaaccaaaacaaaacagaaaaacagcaucaaugcccagaccaauuacuggauauacugaauuugaucacagcaaugaaagaaaaggggagggcaugauucccaguuuucagacuauaggcgcaaucuaaaaugacuauucuucuuucuuguuuacauacaaauccaaaaaccuaaaaaagaaaaagaaaacuaaggggccagcaaggcaguucagcaaggacgagcaccguugcuccugcagaggaccaagugcgggucuaggcaccucugcggagcagcucacaaccuacugcuccaggggagccuaaauucccuucuggauccccaggaacugcacuucacaugcacagcucauucagauccacauccauacacacaauuaaaaaacagaaaguagagacaaaacguuacgagguagacagguaagaugucuucugagaaccaacugcagaaagcuauacuuuggccuuaacauacacagugacucacuggcacacacaucauacacauccuacauugugcacauauacaguaaaaauaaaaauaugaaaaaaacauuaguaugcuauaaaauguggccguucgaaugaggaugggccauuuaagcucgcguguuugaaucuuugguucccaaugguaguacuguuugggaaggauaaggagggguguggccuugcugaaagaggugugucacugaaggguggucuugagguuucauaaacccucaccuagcucugucugucucuagugugucuucagacacuccagaagagagcaucagauuccguuauggaugguugugagccaccaugugguugcuggaauuugaauucaggaccuuuggaagagcagucggugcucuuaaccacugagccagcucaccagccucccucagcuacuucuuagugccacacucaccugcugguaccaaacucuuuccaccacgauaauccugaacuaacuugcugaaacuguaagccagcccccaauuaagugacucuuuauaaguugccauguucauagugucucuucacagcaacagaacgguaacaaaaaaggcaugcuucugcuagaaguaguuguuuagggcaaaauaacuacuugacuuuucccuaauaaucugcaaagacgucuacuacagauguaaaggaacacgucuaugucuucacauuaugaaaguuucacacucaugaggaccaugguagagauacacgcagccccugacuggcccaugagaacuacaguagaaaacugagcauacuccaccugagaagaguccggaguugucaauagguccaggaaacagguuaugcuccccgacauuguacaugucccagcugucaaagcccacauacuucuuccacugcuugaaccaccggcugucaauaagauaccuagggagaaauagcagcuacauauaaaauacagcugaauaaagaaacacaguuuuaaaaacccaaagcauuauguuuugcagcucuccuuuaauuuucaucuuuagacaccuaccuuaagcuccuuauggucuucucaccaagguaauauacaauucucacaaaaucacguuuggggggaggggagcuuuucaagauaggguuucucuguguagcccuggcuguccuagaacuugcucuguagaccaggcuaaccucaaaugcagagaucugccugccacugccuccugagugcugguacuagaagugugcauuaccgccacugucgacuaaaaucacacuccuaauaucaagaacagaaguuagccccacauggcagagagggccuaaucuaugccagguauucacuaagaaaaaugacugcuaagagaauaaguagaggaaguuuguggugacccacaucuaugauuccagcaucugugagguccaggcaaaaaggucaaucuacccugcacaguaagcuugagguucccucccuugggcuacaagagacccuaucuguaaaagacaaaacaaagcuacacaugcuagcacaugcuggccuuuacaucccagcacucaggaggcauagacacuuggaugucuaugaguuccaguccagcuuggucuacauagggaauuccagaccagucaagguuaccuaauaugaccacgucugaaaaaaaaugaacaagggacuggaaagauaauucagagguuaagagagucuugugcucugccaaaggacucaaguuugguuccuagcacccauguaugguaugcacaacucuagcuccaggaaauccaacagccucuucuauucugcauaggcaucugcaugcauagcgugugccauacauucucauauuccucucccuccccccccucucucucugccugucucuuucucucucacacacaagacacugcgaucacuuaucuguaaucccagcacacaggaggcagaugcagaagagucugcaagucuguggccagccuggcuacaucucaaguuccaaaccaguaggggccacagggagaccuugucucagaaacaaacaaccaaaaccauaaacgauuauugaaagaauuuuaaaacuaauuaacuuuggagauggcggggggggggggggaggugcacccucaguauguagcccaggauagccuugaacuagagagauccaccuguguaugccucccagaggcugggauuaaaguugugugacacuaugccuaguuaggauuuaauuuauuucaguuuuucgaaacaugguuucucugucuguccugucuguagacugagcuggccucaaacucugagauccaccugccucugccucccaagcgcugggacuaaagaugugugccaccgcuccugggcugaguuuuucuuuuuaauuaugcuuugguuaugugccugaguuugagcaugacucccagugcccacggaggucaggggaguugcuaucccuggagcuggagcuugaguuacagauggcagggaggcaccaaacccgagugcugggccucagacucaggcacugcaagaauaaucuaaguucucagaugcugagcagucucaccagcccaugagcaaucauuucaaauggacucuuucuacaaguaaaacuauguuacuaaguuauuaaucacauuacccaccaccauuuuuuuuuuuuuuuugagacaaggcuuuuacuaugucacugagguuggcccugaaauuuggcagcaauacuccuccaggacuaagacuacaggcaugagcauccagaccaaccugaauauucuuucugugucaucccuuugcagaauuucuaaaguaccucucucuauuugucuggccuuucacuggcucaauuuaaacaccauaaacuacaccuagaccacaccccaaacacauaaguucuguucucuuuuucaguccucauauuggucauaaucaaugagaaaccuacccuauuauuugacuccuacacagcagcaccacccaggcauuucuccccgacuggggaguacaaucccuucuaguuaacaaucucuuaagaggccucauauuugaaucugcucuaguaaaccuggaacuuuuuuuuuggggggggggugcugcucacuguaugagaccagcccugaaccuacagcaauccuacagccucugcuccugcaaaccaauaaagcauaugccagcgugccuggcaaagucuuguaacuuucgaucuucuauuuugcuccaggagucaagcuccccucccuuccccuccccucccacucuuacaucuaacuacugcuacaauugucccggaccaucugacaacuggcuucuaguuuuuggcuuugaauccugucccacgguuuacaaguuacaaaguaucacaguuuacaaguuacaaaguauccacuucggauccucucuccacgccaggagcguccuaagccacaaauugcuaccgagguuuuaauuguuaaggaucggagguguguaagggguggaaacuucccccaccaaggucaccaucaagcgcccaagucuucggugguuaagugcuuucccccaccuucccgcucccgccgaccccagcgcgcccccuuuucuauauucuacacccccuguccccgccgguccaagacuacugugaauccgaauggaccgggacaaaccccacgccugucagcgcugucccccagcugaucccgggguuucuuucaucagcggccgcugucaagccacucuuucagacuccaggcaccgcccccggcccgccuccaccuaaaacugaggacagagguccggccugagggccagcgagccggcuagacgcucugcgccgcaggagggcagggcggacgcucaccacugcgccccacguuggagcgugguccccaucaaggcuccgagcuccgucuucugggucuccacauccggucgcucacggcugccccggccuuccgccaucucguccgccgccccggcccagccggcccggacauccgccuagcgcacggcgugcuaugggccgcgcccacgcacgcacguaaccacg

SEQ ID NO: 12166 - RNA, 18313 nt, Mus musculus
uucaagaucacuuuuauuugcagagccugcaacuguugguuaacaaugcuagcuaugcugguacaaucugcaagccauucuccuggaaagcauucagcuaacagaaucucuacaaaccagaccagggaccaacugggacauacuucaacacgccagggaaggggcugcucauucccuugcucuccacauauuuucaaacaagauuuguuuaauagccaaaugcaacucaaacccauaacaaagcaacuagccaucuucaauaucacugauucccuccccgcccccagaauagaaagcagagggaagaggggagacucuuccuaagaaaaaccuggcuagaccccaauggagcaaagauagcagagaggcugguguccaaggauaucaacaggcaggcaccaaaacaggcugugcagaaucaaagcagccuggccccucagacgagagguguuuccgagagccucacuuccaugggauuagauuaggggguaacugaugugauucaccacucucugacccucaaauuaaaacaugauaaacucugaaccuuugacuucaaaauuuacuacgcccuccugagaaauuccacaguugucuguaggccaggauacauaacagccugggcuucccgccccccugcucacccuugggugcccacccaacacugauuggauauuccgacucauaaaaugacuuuuuuuuuuuuaaaaggacauucagugggcaugcuccucccucacucuguggacuccacucuuucaugcccccccucuuccaccuuggggcacacuacagcauuccaguacuggccugauggaagcugccuaaagugccuuccugugacuccuacaccagccacugucauggggacguggggugaggaguggagacaagacuuuccccgaggaacacugcaaaaugcagaaguaggucugggaagguuagcuuauguccuguagccaagccuggaucuggugcaggcucuuaccagcaucucaguccuugacuuugaguagcagcaauacuggucugcagcgccuccuaggggugacugagcuccuugcgcuguucacaacuuaacaaguuugccuuuuucuuaucccugccccauuuuuuuuuuuuuuuaaauuaaaaguagagguagcuccuaggaugauaaaacucuaccuagaauggcaguauuuugacuuaaugaagcagaaaaguaaaagucuugaauuaaaacaauaauaaaauaauugaugaagcugaauaaauuaaaguuaagagucauccacgaggcccucuccucccuuccagccuaucuuugguauuuggccagcagcacuugggcggcuuuucucuccucgugacaggccagggucuacccaauaaggccuucuucaugggaugcucagugagagcagccuaacacgguguugcagacuccagucugugcugugcuuguccagcuuuggcagacaguccugacagggaaggacucuuacagaacagaagaguguaacggcagggugcccuaggcuccaaccugggaguguaggagacagguccaaggaauggaaggcccaggucuuucuccagguaccguacagcuggccccuuugcuuacugcucugcagcaaagggaaaagggacggggcagagggaagcucaggcugcuaccauuuggcuucagagcuucuucaggcgacuguacaucucucuuuugcucuuuucuccugcccagguccggcucuuggugcggaacuucuuuaggucuucuuuaaagucuucauggugcauuggccgguagcugggggguucacagugagacuaaaggaacaggagagacacggucaggauacgccugccucauaucaucuggcuuccucugccuagagcugcaaggcugggaaggcagcaagcaggugccagugagcaggagccuggcacuuagcagaugcauagugcgcccccagaccccggcaagcagcagccacaaccgacccaauggcccagcaugggggcguggggacaugcucacagacaucucaccuggcacuucaaaaagaacuccuuguauccccccuucaggacauacagcucaggguaguggagcuugggguacucauugccgagccuaucucucucucucacauaucggcaccuagugaaaagaagugaaggacacagucgggucaccuccuucaggcuaggggacaggacacaacacaggugguguccuggcacuccuuccaccugccugcugccgacaccaucugcagcaauagcuuagagccagcgugcucuccauucuguccaugguccccucauucugcuccucucacccaaguagaagucuuccuucuugugccuuuaaacagccgaggccuucuacuuccccgguagcuacuagaaccccgugucucucugcacucugccugagcggcacgaaagccacaguuuucaguguccuacugugugccgccucacaucucauucaccccacucgucuccuguccucuaucugggagcuuccacucauugaccucauuuugaaggacuugugaacauuuuguacaauucuaaguuuuuaaaauaugcuugucugccuccugucuacucugaaaugucccuccaggaagcuagacuuuugguuugcuauguuguuaguguuaaauaacaauaagaauuugagaguggaugcaagcccccacuaucuccauucaugugugaauauucaguccuacucaaauggguggguuguuuucuuuuuuguuguuguuguuugggugacaggaucucacuaugucacuguaaugagauccuguaguagucuagacugaccuugaaucugagugcugaaauuaaaggcaugcgccaucauaccugcccuugaacccaggacuucacaaauacuagagaagugcucuaucugauaugagccacacuccuagccuaacaguacguuagugugcuucuuauaggaucgcaugcagcucaggcuggcuuuacacuucugauccucugccuuagcuuccccagggcuggaaccagacaugcaccaccaugccagaugcuguuuuagaguaucgccagcacaucaacaucugcagaggaagcucuccagacuuuucugcccuuugcuuaaggaacaacugcuuggacguuaugagacuagucgguagaacgcaauacagugggggaaacugggagagccgaaguaaaaaucaauauaaaggaccaacaagagugagucauuuggaaagaggcugaacccauggugauacuacaaaguuacaacugguaucaccguaagacugaacuggagaagccugaaaaucauuugcaaucaaaacguaaagguuaaguucaucaacuacauucaagaaauaugucugggcugggugguagugucacaggccucuauacccagcacccaggaggcaaugaagauggaucuuuggguuggaggcuagcaucaucuacauguccugaguuccagaacauuuaggacucaacagagaaacacuaccuugaaccccuucuccaccaagaaaggaggaaaaauguuugggagagcaagauggguaaaagcugcucagaaauccacacagcagagcacucccccaagcugacuucugaacuccauauacacacuaugguagggcacuuugcgcgugcacaaaauaaaaaaaaguauaaaauaaauacuaaucguaaaaaugucuauuuggccgggugccuaaaucccugaggccagccagccuauucuacagacugaguuccagaauagccaggguuacacagugaaacccuuuuuugaaggggaaaaaaaaaggcuguuugaaagacaaaucaguggacagaaguccaacuaagggaaacuauguuauaauaggaauuauaguuuccacaaaagccauguauacacauaauguguagacuggagcagcacuggagcgccuugugacuuugugaaaggugccuguguuaggguugugacgugugcccugcucuccacugucaggaagccuccgccccaaagccuuauucucugugguacucacauucgagggccucuuucagaggaaaacucacaguggaacacgacaaugacacgcuugccaucaguaggcacaauaggguucuuaaguaagaagucuucaaccucuucuuccaugugcagauucacggcacccuguggagacagcagacacugagcaccugcuaagccacacccaggagucuguaggucccacggcccagcagcgcaguagaccaccugccuguuaugucagugaggcuuucucuguaggccauuucuaaaugucacuucauaaagucagaagcuaauccccacucacauuuaaauccugcuuuuuaugguaauacuaaacaggcaugaccagcuccuuccuucuagaaaucugguguuccaacaugucccuucccaagguaggcagccugacucaacagcagagccuugguacagauaccagggccaugcugccaaacuggcuucuuuuacucaggagcucuggggugcucaaacauucauauuuaaauaucccaaaugcuguggaacucuuuguggccccacugaauagcuuagacaucagggaugccaccuagaaaugcccugaaacaggacaguaugagggagugaaguggaacuggugggaauauucauucaguuuguguauauuggccgucagccaagagaugucacuaucccaccuucuaagacucccaagauaauaagucucaagaauccaaaccuugaugugaccuccuucauacucauauggguaucggcagucaaugauaacaaacucuuuaaugagaccggcaaacuugccauucaaaacagaugccaucuaugaagagagagggaagagggugucauuugcuggcugucagguaacgagauuccaacuccccaaaugcaguggguuccaaaagccugacuuacaauuucuggagaaauauauuucaaauccugaugcuucccagagacuguauuaaagagauaacccuuuagaaaaugaaaaaaaggaaacagaaaauauuuagaggaacgugaaagcuugcaaauauuaagguuuauucugcugccugugugguaggaagcagcuugaaaaacaaaccgagaaacaaacauaagucaauacuauaugcuaauuaccuuucuaugcacuuaaucaacaucuagauauuuaauuauuauuguuuaaggagauauguuuucauuauguagagcaguccagcuccagacuccgaggugagccugcuccugggguaaguuaguaaaugauuaugcucacccucugggucuggucuuaccaccuaaggagucccgagucuagaucugaacacagaaaccacaggucauuuccuuucuccacuggcuuuucuuuuguuacuguuuuguuuuguuuuguuuuucaagacaggguuucucuauguauccucagacacagagaccugccugccguuggaaugcugagauuaaaggugugcaguagcugcagcaccgcccggcaccuucccccaccccccuccuguuuuuuuaucaggaauucucaucuuaguaugagaaaucacuuaaaugcagagaggacagucaggccguugugguacaaguuuaguccuagcauuagggguugggaggaggcagaggcaggcgaucucugaguucaaagccaguagggacuacaacgaguuccaggacagucaggacugcauagaggaacugugucuggaacagcaaacacacacgcagugaggagaucaggugugacucaggaauauaauaacagcauuugggaggaggauauaaguucaagagcaucccuaguuuggaguuuggagccaacuuagaauaugaggugguucuguaacaaauaaaaccacaaagacagugggugugguacuguaggcugaggcaguagaacuagguuaauuuggguaaaauagugaggccacgccuuggaaagcgagacaacuugcucaugugaugggcaccugguugcucaggauggaguuagguagugagaauggaagaacaucuuggcccaagccuaacaaggacgaacaccucagugcuacucagugcuguuuaucccccucaaaaacuccuuguucuuccuuguuuuguucuuuuuagacagggucucucucuauauagcccugguccuugaaguuacuguauagaccaggcuggcuucagucugucuagcucugccuuacaaaugcuaagauuaaagaugugggccaucauggcuagcuguacuguaccauagcucaggcucaugcuuucccagacacacuggucagagugaagguaaccguacagggaaccaccgagccagcaagucucaugaccaccacgugccucauccugacaaguucagcugagcugauuguucuuuagcuuuuacuuuuaaaacugcugccuuggcggcacccaggggcugccuugaggaaggaaggagcaagguaagugggguucuagcaccccuugccaacaccaccggacuagagugacucugcuugcaguuaccuuggagaaaucuccuauaaggucucuugggucacuguccaaaauguucucaaugguuccuuugggggaagacaucagggauagagacugggauggaagcuguaagaaauccaagguagagaaugagaccaggguuuugauuaaaagcucuacaauuauuuaccuuuaccaugccaagaaaaggaaacugaaauaugaaugccuauaguaaguaaaagauucuguacugugacuuaagcagaggaaggauagcuccaugcuaucuaguaacuaguugaauuucccugaaacccacgaaucucugguuggccuggaacuugauaauguagaucaggauagucucaaacucaaagagugcacagagaucaccggcaugccgacacaccaaccagcaccuguccucuuuuacuguucgcaaugagaacuguugaggugauaccaagacaggcgugagauacaaucccagaggcaggaggacugccacaauguugagccuagccagggcuauauggcaagaaucugccuuaaaaauaaaaauuaaaaaaccaaaaaccaaaucaaaaccugaaccugacacuguaacagaagaucauugucauguaucucacaaaauaacacauaauuacuuuaucucaguagaguuccugaacuucugauaaggaagguuuuuguaagaaaacaagauuugaguuguaaagaucauuuggauggcuucuaacuaaacagccuucuguugugauucugcucuacagcuacacaaggaaccacuguguaagcacgccugagaacuguaaucuagaggcaacaggcguaagauuagaacuuugaacuauuucuuuuucucuuccaaggacagcaguaaaccuuucaaggcacgaugacgucagugaggugcucagaggguaagaguacuugaaugugccugacaguccugggaucccaugguggagagagaaccaaggcugcacaguuguccucugaccccacacaugccauagcacacacaggacuugcaccacaacaguauuuaaaagaagggcagaggggagugggcacauuaagauucuuucucaagcccagucugucagguuagagagacccagacagcacucuuugaugcccccuuccuuaaauaggaaauuagagaggcagauagaucuauucuuuguuuagcaauaucaagaagcuggagccauucuauuuuauagauagguucuugugcaccauggcacaggcacaggcacacacacacacacacacaacaaaauuucaaaccaaaacaaaaaccuggguauggcuugugauucuagcacaagggagguagagacagaggaaaaguucucugaccucuaaaugugcacugugguauuuauaucccuaccucuugauaaaugaauggcauaggaaaguaagaaagagcagagauggagcaauaggcacaaugcccuggguucaauccucagcaccaagcaaacuuguccccccaaacacaaaccccacacccuaaaaaacaaacaaaaccccacauaaugcgggcugaagagauggcucaagaacucuuuguugucuccaguacuacaugguggauuacacuguuaguacuugcaguucuaggggauccaugccuucccacccugugggcaccagaauugcacguuguacagacacauaugcagacaacaauccuacacacaguaacagaagaaccaacucccccaaguccauauaccauccgaucacuagaaagcuauggugguuucaauggauguacccacaguuggagcauuaauauggggucccaauugauggcacugcuuaggggacuaggagaagugguggcguagccagaggaaguugccacugggcuucuuuucuuuuucucuucuuugugcuuugagacagaguuucucuguguagcucuggcugcccuggaacucugcuguagaccaggcugggcucaaacucagagauuuacuuuccucugcuccaccauguccagccuuggacaccuaauccuaaugccacccccaggucacucugcuuuuucugcucccaugccuuucugccaugcuuucccucagugaugguaauacccuuaagccccacaccccuuucuguaacuugccuuagcuguggcguguuaccacagcaaucagaaugaagcuaauacaaacaccugaaaugaauagcacauuaccaaccacuacucagaaacagaaggaaugcagcucacacccugcuacugagcacgccauucuggaaaaugaucuggcagcaccugcaagacugaaugaaccauacaccugguccauggcacagcaauucuaccccuaugagauuaucuaggggauaaagaggaguacuggacucuauagaccaguaggaaccucuagacaugacaagugacucaaguuccuuaacaagacagacagaaugcaggaugguggugcacaccuguaauccaagcaccaggaggaucacaaguuccaggccagcccgaaacaagacucugccucaaaagccaaagcaaaauaaaaaccuagcaacagaugacacaaucuucuaaguaaaaacaaacagaagcaaauaaaaguagcaaggcuugcugggcagugguggugcacuccuuuaaucccagcgugugggaagcagaggcaguuggaucugaguucaaggccaaccugggcagccacagauauacagagaaacccuguucagaaaaaaacaaaacaaaagaaaagagcaguaaggcuuaguaaggacaggacaagcaaguugagacguuuagagccacgacuguuguuaggacucuggaucaagggagaagguaacuaaccugggcgggcuccggaacauccgccuucgccuucacagggcugggcacacucuuccuccucuuuguaccccgaggaggcuccucgugagaccggucugcucucuucaacaccgcccgagugcuggagccgcacggggaaggggagucaaacagcccgcaacgaucggccuuagggucagagacagguccaaccuuggauuaaaauccaaccacuugaauggcaguuagucuaaaacccagccccaaggucaacauaguuaaggaguacuuuguuuaguggcucagcuccucagaacuccacaugccgaguaacuuacaagguuugcaggucuccucaugacaaggggagcuguccagaggcuugccaugcaugauggggucuccucaucauucuagagcaagagaaaacugcuuuuaaauacaucuagcagaggggcuaggaagaagaaaaagacccagcaaccaaauguuuugcagguaacucuccuaagaaaugccagauaagccuagauaagaaguuuuguguuuuguuuuggagacagagucuuacuguguuuggcuagcauccugaauguuaaaauuucuggcauggaacaccagagcaggccuguuucuucuugguacaagggauugauugagccuaaggccuuguacacuccccuaagcacaugcuauaucuuaguuccagaaguaucucaaaaccuuucuccuucccuaucguuagugucccucaggguaaggagaaagaucuuaccaguauuaucugaccuaucacccugcuggauuuagucaaacagacagaagacucaaugaacucucacaaaaugaacuguuuuuuaggaggcuucugcaggcugguuagaaugaacagacacgcccacacccacagacuguaccuucauauucucgccauccagaaggucuaugaagccaucauccucaucggacaaaguggcuuuuacaggugacugggguauaaaaagaggacugaaauuuccugauucacuuucauuugaagauagcugaaagacaaaauuagcaagaacucuagaccacuuugauugcuuagguggacugcugaaagaaaggaaagaaaaaaagaaagagagagagagagagagagugagugugugugcaccgugugaaccuagcacccucagagucagagaggggacuguacucccuggcuccugagcucaucuugcagugagaacuaaggccaugugcuaaaggcugugaucagcuaaaccuguugaaaauacaagugucaagccggguggugguggcacacgucuuuaaucccagcacuugggaggcagaggcagggggauuucugaguuugagaccagccuggucuacaaagugaguuccaggacagccagggcuauacagagaaacccugucucgaaaaaccaaaaccaaaaaaaaagaaaaagaaaaaacaaguguuuauggaucacaaaauagcggaucagagaaaguucaagaaagcccaaguaacuccagacaaauggaaacaaggggaguuuguucuaaacucuaccauauuccuuucuuuuuauuucaggagacaggacagucaaggaugagauaaaaccugugaaccucuuucuuccacuucccaaauguugagaucacaggugcacacuaccaaguuuggccucuaaccuagcucuccauuaggacuaaagaagcuggugcuggaaggauggcuccauggguaagagcaaauacugcucuuggagaaacuuugaguuuaauuuccaguaucuccaucagacagcucacagcugccuguaguuccagcuucacaugauccuaaggcccuggccuccuagggcagcuauaugcaugugugcauaccaccccgcuccacaaaauuaaaaaaagugauuuaaacuaaaaugacagcugcccaguauuuaaaugagggauuaugauguccuagacagcaacaaaaucuuuacaacuauagucccauuuaaggcacaccacucgcuucugguagucaaucucuuuuuucuucauugugacuaaguguucccaguguucauucuaucucagucccagguguagcugggacuacgugugucgacauagccaaauaaucuuuugcuuuuuguuucuugaaacugaugcuuaagggguaccaagaucauacaccucaucuaugcaaugcccuaccuugaaaacgaauuugguguaguggcaaacacuugugauccuacaggcaggagcaaaaagaauucaagacuaguuuugacaaauuugaggcuagccuagggauuuaagggauucugucucaaaaaaaaauugcgaguaacagcaaacucuccaguccaaacaaaagccaaaccaguagauaagcacaggcuuuuaaagucugcauccccagcauccauaauacaggugcucuuaaugcuuaggcaguuacagaucuuagcacucucacucccaagugucuaccaaaaccaaucaguuucagauauauuuucaaacuauuaucauguacugaggaaccuauaguuaaauucuaguguuuuuacauguccuuugaugaguauaucaacuucucuaaugaaacuuucuaaucugccaaaugaggcaacuccaguuaauucauaggccucagccaugagccaucaaacaauaacaguaaacuugcuuuucuguuuuugaaacaggauuucauguagcccaggcuguucuuaaaucauagcagagcugagcacaaccuugaacuccuggcccuccucccucuaccuuccagaugccacagcgcgcgcgcgcacacacacacacacacacacacacacacacacacacacacacacucuccauguuguaaauacgaaagccacacacacacacacacacacacacacacacacacacacucuccauguuguaaauacgaaagccaaaccacguaccauccgagcuggggcugaauucugccuguguguaaagggaucuuuacucuccucguagaugugacgagaugcaggucguauuggcuuuuuaaauucaaaugcuuccugcaaaacaacauauuugaaauauuuucuacuguccauaaaacagcucuagggcuggugggguggcuuggcugguaaauacacuuucugggaagccugaagauggauuagaaucccaucccuguaccccacacaguggagagagaacacacuccugaaagcugaccugucuucaugugcaccgcggcacgcucccacccaaggcuuucucuuucacuaaauaaaauuaaggaaaauuuguugagucuagagagauggcuuagcaguaagagcagaguuccuuucaauucauucauucuguauucuguauucugagacaggguuucuuccuggagccgugacuguccuggaccucagucuguacaccaugcugcccuuguccaccugccugucucccaagugcugggauuaaagaugugcaacccccacaacuggagaacacaguucuaaaagacccagguuugauucccaguacccacagguuggcuuacaaccaucaguaauuuguuucaggggaucugacacccucuucaggccuuugcagacaccaggaacauacaugguacacagacauacaccaaagcagaacaccaugugcagaaagaugcaugccuaucuuuaaguuacagaagcacacuuguuauuaaguacuaaaaccaguaacugcuaauaucaguuuuuauuacuaaguacucucugaacauaagcuuaucuaaucaucaaauacaaccugccuguucaguaagaaaacuacaucuacagguucaauggugugccuacgaucuugaagccagagaggaccacuccagaaaguuauuuaaucuaucuauuucuccuuuagagcaaagcuuccaggaagacaaccuugggagaagucaaguuugagucaagagcuacaucuagacuuugguccaguuguacuggaaagguugacaaacugcuccaagcagucaaggagggaauccauuugcauggaauaccucaugaugucucccuaaguugccagacaaaaucugcuuucauacaagacguagguuuuguaaggguuauugacugguauuuuggcaggaaaugggaaacaacaaauauauggaaauagaguggccgagaggcaagccaaucaaucugaccaacuauucuagacaagacacccuguacaguuuaagagagaaagccaggcagggcacacauggacuucuggauaaaacacaccauccucaaagcaaccauuucagauauucuccacagaacuugcauggcuuuggauuuuagcguuucaauccaguguuuauaaaugugacagauacucaucggaggaaauaagguacaggaaaaaggcgcuggccuagcaaaacuccagcaucacaaagcuagguagaagaagcaagauucaaaaucagauuucucuacugagaggcuagguguggccuuuccauuagucagguuagauggcagcccaaccaugucacuugucagcugcugacagacacuuagguuucacugccagcugggguugccauggugaugcuaugcuuacauuuucuuuauuuucauccuggucgaugaggugaaaggugucguggucuagagaaucagaguggcuccucuucagggcugggcuacaucccaggagcuucugcuaucaaaguaaaacagagaaauugaguucacagaggcaagcacaauggaaaacucagguuaccuuuuucuuuuuuuaagauaagguuucacuuugaagacaaggcuggccuugaacuugagaugaccuuccugccucagccucccaaaugcuaagauuacauguuugaccuauuauacccagccaaaacuuuaauucuuaaagaaaugaagugggguuuggaaaaacuagcuuaccaccacauaagugcccagggguucaaccugcucuaacucagaauggccuuccaccuaaucagacaaggugcauugaccucuuggcagguaugauauagugccauaccaacccccuaguaacauuugcauaaaaagaacauuuccugguuugauaaaacugaggugaguacaaaguccacaagaggcuguuacuguugaaguuccucuagguaauaccuuacugccuauguguuuacagggauguagaaaagcaaugcccacuuucucaucguagggaaagguguuugauggagcaauuuacagguauuagcucaaaacaacagaacuuacagguagggaauuuauucucgucagggaaauuucaaggcuguaaugagaucaaaaagguaaacauaagaauaaagagauauucauaugagcagauucacauugcucaaccuagaguaggggcauggcaugguucucauuguagcauauacaagaauaguguucucugaucucaggagcgccccagaucgaaaaaaccaacccaacccaaaccccaagaugucuccuacaauacauacauccguucauuuaaggccuaacgucaaaaaggagagcaggggaaauuacagcuaaccuaaagggggggaaguccugcaaacugcugguaugaagcagcacucauucccaguaguguuucuagcauccgagcaacucagcaggcacagcuaacuacagagcucuaguccacuguaugaagaacguuauucaaaaauuaaguuuugaccaggagcaacagcgcauaccuuuaacccagcacccaugaggcaggcaggcaagccagggcuucaaaaugagauuccauaucaaaagcuaaccaacaaguuucuuccuuuugggagguucuagggauucacccugccuggggccucacauaccacacgagcacucuaucaccgaguuugcacuuuauuuauuuauuuauuuauuuauuuauuaauuaauuauauguaaguacacugcagcugucuucagacaccagaagagggagucagaucucauuagggaugguugugagccaccaugugguugcugggauuugaacucgggaccuuuggaagagcagucgggugcucuuugcacuuugagacaggaucuuacuacauugcccagacaggccuugagugucugauccuuucgccuuaacuucccgaguagcugagaccgcaggccugugccacugggcuuacuuaaggaaaacuuuccuucuaaguagaaaauuuuaaaguaacgaauacauacuuuucuuuacuguccaagggcccaggagaaucuagacagaaaccuuugagaaauaaaaacaaaauucuuaggaaguaauacacauucugguguuaagcaacauuuccuaagugcacccauggauccucuauuugcaaauaccaucaagggaaacaagauugaagaggccaacuaauaucaagauugacugauuuuuuuuuccccagauaguacugaccccucuaaguuuuuguggaguuauuuuuucaaauguacucauuuagggguaugaaaaauacaaccagguaaguucaguuccaaggggccaaucugguguauauagugacacugugucuucaaaaaguagcguuagagagauguuucagaagagcacaauugcucuuguagaggaccugaguucaauucccagccaccacaugcuaacgccaguaacucaguuccaagggauccgacacccucuccuggccuuugaggaaaguacacaccacaugcacacacgagaggcaugugagccaacauccacauauauaaaagcacacauuaaaaaaaaaaaaaagaaaaaagaacuggaauaaagauuuggcgcuucuucucuucauaaacugucucaggagcuuccucuguacucuacuaaaggguguuugucacuucacaccacaccacaccacaccacaauuucuauguguacuguugccaauuaaauuccuaggcaagaugcuucccgaauggcugacuccagaugaaugugaaggcugaacggacaccuggaguggucagggggauggaugguggcccaugccuuuaaccacagcacucaagaggcaagaggccaaugugaucuacauggugagacccugucucaaaauaaauaaauugauuuaauuaaauucuuaaaaauaaguggcuuagugguuaguagcacuuggugcuccuguagaggggacaaauucaguucccagcagccauaucaggcagcucacaauggccuguaacuccagcuccagcggcucugaugccuucugaucuaaacacacacgagcacauacauagacacacaugaacaguaauggcaauaccugaaucggucgauucugaggagcccauucucuguagacugcuguuauuucucacuuccauuuucucacagucacugaaaccaagagaggcaccuccacaugagcaauuucuagcacaugauuaaaaaaaaggugacauacaggccacgaaguagccaggcugccacaaaccaucuuugagagaccaagccaaggacaccccacuuggccacccagaauaccccaguuggcauuuaaacaaagaaaggagugagugguuuggccuugggccacauugucagacaggccuguggcaagggcuggguuuccuuaaaggagagccucagucugagguucugagugagccaggaguaagggcaaaggugacuaggccaggagucccagcuuuucaggguuugcaaaaguuguaagacaaguuuaggaggcgaaauacccaacaucgaaggaaaagcaacuucacuaaaaauaguguuaagcauuuuuguuagugauagugguguaggacuacaaaguccucgaagauuuccaauauggaaaaguuagguaaaaagugauagcuuaaaaaagguaguagauggguagauacaagaaacgugccggccagguggcugcauagauuuuacacaaaugcaagaaaagaaaaugccacgucccuuuguugagaaggaacaaagcuuacaggaaacuaagauccggcgcgggugguucagcaaagagggccuaggaggacccauucucacccucccucccaacccccauaaggguagauuccaaagacuuuucuggaauagagacagcguagagagaaaucugaaaggggugaacaagacaggaugcccagcaggcuuccucgaucuccgcggucuggcucuuggcugaggauagcccuggacuauccgaacggccucucccgcccaacauuccgcccgggagggagggugcacauggcgggcccuagccaggccauuccgggucggagcaucagaaccaaguggacagacucuguuuccugcuggaucaucccgagggccgaccagaggccagcggccuggggcaucgcucgcuggucucucaccugcccaguccuuccagcugguccauggugaccgucagguuggugacaggggacaguccgccagcagcugacgcgccaaacagcaucuuccccgugggcugcggcgcaggcguggggcugcaagcgaagaacaggcggcggcggugggggggcuccgggcccaguuccauggcgccgccgggccugcccggacucccgcuccgucuuccuccgccuccgcugcgccgggccccgccccgcuggcaccggcuucagccgcgugccacgccaccagcgcccgcgggucaaacacaaacacgaccccgcgguucagagacgcggccgccacgggcagcggcgcggaccggcgagcguaggggacucggcaggcgccaggcacaagcaccggugcuucccucucugucccgcgaggcccgcaggcgggcgggcgccugcaaccucaagauuaaauccaaacaaacuccguggaggaagagucuugagaccaccgcuccgacuaacucgccucacuuuuuuucucccuccuugcuccguagccggcucgcagagaaggaaccuucacuucccucaccaccaaagugg

SEQ ID NO: 12167 - RNA, 13936 nt, Mus musculus
gaagaagcgggugggggggggggaauucgaacuugaaaagaauuggcgcucccgaaggggacgaggacaaagagugggccaggauggacguggcggaccccgagccguugggccuuuucuccgagggcgagcugaugucggugggcauggacaccuucauccaccgcaucgacuccaccgagguaaucuaccagccgcgccgcaaacgcgccaagcucaucggcaaguaccugaugggggaccugcucggggagggcucguacggcaaggugaaggaggugcuggacuccgagaccuuaugccgcagggcggucaagauccucaagaagaaaaagcugcgcaggauccccaauggagaggccaacgucaagaaguaggugccaagggccuggggccgacgcgggcgcugccuugagcuccuugggcagcccuuccuccuacuuucuggcucuucucuuuccucuaaccguuuucucuucucauuuccuuccuccuuuuucaucucuuuccuuuuacugccuuaucuaccccaucuaucccugagcgucaccucguggggucuguauguuagggcagccugcaggacuguccuagcaggaggucgugcagccaacugcgccuccagccccccucuuugggccagguccuggcgcaagucgcgccuggcuucuuuggcgggcguugccaggcggguggcuaguuuguuuacgcagcuagagggaaccgguggggccaaaaauaauggugaagggggugggggggguagccggccagugcuugcgcaggucccugcggugucgugcgcguaguuggcgucguuggcccguggggacucuuuaucgccugcuaggcuuggcggaacuuggaaaacuucaccuaccggcuuccaagaaggggccuuaucuuugggaccagcacuggccacacucugccuaacugaccuugccucugguccugucccaggaaaggcuggcagcuucuuguuuuugccagcugggcacugcuuugagugguacguacaggaaaggaagguggacagauauccaggaucagauguguggacccagggguggagcagggcaggcugguggccuaggcuccucucaggaccuccuuggccuuuuuuguaggaguggucuuaggucagucuugcacuggggaaccugggcacccagcaucagguguuccuucagaggccugagcuuggaaauuccuggcuugaaaucauugucucaagguggaggugccagagguugcucaccuccagguggugucugcuggucuccaaggcaaguggcuuccuuuggcuucaggguaaugguucuuggaagcccaccaugucugggaggcugcccaggccugcauccuggcuugggucagcugcaguccuuguaacacauggcaagccugugugcucucucugccugugacagagggccccagagcucugucugcgacuuccuagcccucaccugcugcuuuaggcuuccugccaucucaacacccagguugggguguggcuugcagagccaggcagguucagcugagagagauuggucccuagauccugaaguaaacccccccccccaugaauuagugaugcuggacacagucaacacuggaggucaucaggacuggggagcuccuacacacuagggugauauaaggagccugcacgguuccucaagacaggaguuggucugggcaaguagacacaugccucucauugcagugcuggagagacugaggaaggaggauugcuucuguuucuagaccagcuaggagugcaugggaaaaccugguuuuauaagggaaacugguugguagggugaaggccccaggacccacaaggugaaagcagacucaguucucacaaguuugcucugacuuccauguguaugcuguggcacauguauauacacacacaagauaaaaaccaggaggagaaacugaggcaaaagcugcagacugacacacugcccugcaguaaggugcuugacuggcaggauacaaagccagguaucuccaugggagugcugguguuccccacuuccugaguggcuccugcagggcaaagccuagggcugcugcaccugcuugugugauccccacucagccacagccuggaaggggcagcuuggcgggcaacagcuggugcgggcagaaaggcuccuuugucugcaggggcuuaauagacugcacuccuguugucucucucacggugaagugucuggaaccuuccaggcaagccucugggguccuguccuccagucugcacacagagcuuucuccuuccaguaccauacuguggaugcaugccagggcgucagguaguguagugccuccguuccuggcaaggcugcagagaccugugcccuuggcuccugucauccccacugugagaagucgcaauaauuuuuuuuaauuuuuauuuuuuuuaacguacauugcuguuuugccugcaugugcaucugugucagauccccuggaacaggacuuagagauaguuaugagcuguuauguuaaauugaacccagguccucuggaagacuagccaaguacuuuuggcuacugauccaucucuguagccucaaguagcaugaucuuaguaccagcugauaggagaguugaggaaguugcuggugaccugcugcuagcucuauggcucuauggcuuugaagccccccaccccucaaguguacugugguuguccugcucugccuuaccuguggggcuuugugugguuaaaaccccauguaaacccccugggugcaugggccuuguugccacuugcuugugcauagauauacuuugagaugagacagguugauaaagccaacccagaauacgguggggaugaggcucuuccauuuccauguugucuguaugguguaguggaaggcauggaucucucuccagcugaugcccucaccaccaggagaaugccucuguaugcuugcuuuuuguugguguuuuguuuucuuguauuguguuucccccaucuagcccuggguguccuggaacucacuuuuagaccaaguuggccucgaacucagaaauccgccugccucugccucccgggugcugggauuaaaggcgugcacuaccacugccugguaacauucuuuuuuuuuuaagauuuacuuauuuacuuuauguauauguguacacuguagcuguacagaaaguugugagccaucaugugguugcugggaauugaauuuaggaccucugcuugcucugauugucccugcuugcucuggcccaaaguuuuguuuuguuuuguuguuuuuuguuuuuguuuuguuuuguuguuuuuuucgagacagacuuuuuguguagcccuggcuguccuggaauucacuuuguagaccaggcuguccucaaacucagaaaucugccugccucugcugggauuaaaggcauguaccaccacugccuggcucauuugguugcucuuugcuaguugcaggucaugaguggucagcugugccugugcucucugaguccacuaggugggggcuccugcuuguccuugcucuugacccucuuuccuaguuccccuugcuugcccuguaggcaagugguuagggcugaaggccgugcagccgaaagcuggguccuggcaguguggaccaugccuaguugaguugccuguccuuugcaacuugucuggccaccaucucuuuuggggauagggagcaccugccugggcagaguggcuugugcuggauggucacuggccacuuaaaagacagggcagacaguguguucagcuguugggugucaccacccuguccagaucugcaccugucugcguugcuggggccaugggaaaugcuggcagcucuccagggacaacuggaggccauaccauggugacuggcaggcugugugauguggauggugaauaguuaggacauuagcgagguguaggaaacacccuggacuuuguuggguuuucagcccucagaucacaaaacauccaaagcagccuugaugagcugcucuugcuaccucccugccugccugccugccugccugccugcuccugcugugaggccacccugugugcccacacccugagugcccacaccuaugcuauagccucauguggcuuacuuuguugugccuguggcaucuagagaucauccucaggugucaccucucagugcccagcacuuccuuucauacugauaggaaccuggaaccugugacuagaugaagugacagggcucaccgguauacaccaccacagucggauauuuauggguauugggagaucaaacucagauucucuggcuugcuugucaagauuuacugucuccccaguccacuguuagcugguuucuuuggcagggaauugaugcuuccacaagggaaccauguugguccacagacucaguacgggguagccagcgcacuggaaugacaggauggaguaucugcugugcgggcagaauucaggacucugcaucaggcaugggucacacuuuuacuuucccagugccagacccugucacugagcucugcuuccuaagaacugaguugggaguguccccucucuuaaguuuagagucugcuuaggaugugggaugucuguuuuauuuuauuuauaugaguacacuagcuaucuucagacacaccagaaaaaagagggcaucagaucccauuacagaugguugugagccaccaugugguugcugggaauuaaacucaggaccucuggaagagcagucagugcucuuaaccacugaaccaucucuccagccccucaccugcuuuucuuaguuaccuaaaagaaauccugaacacaggaggauggcaaaaagcccugaagccaggugguugggguccuuccugggucugaaccugcccgggcgcuuaggcucccugaugcccucaaguacuuuccugugggugagaguuggaugcuggaggcuucaguaaggugguuuuguuuguuuguuuuuaugaaaacuuuaugaguguuuugccuguauauuguacuccaaauguaccuggguaaccagaagagggcaucagaucuccugaaacuagaguucuggguaguugugagccauuguaugagugcugggaauugaaccagggucaucaucagcccagguuagccucaaacucauaaucccccugcuuuagccuccuggguuuuggguugcagauacauagcaccauguccagucaugaggaugcugugcuacugucucauccacuugucuucuugcugucaccuagcaccugacugaggccacugaggaaggaagcgauugcaggcagaguuccucccugugggggagguaccuaaugacgaacaugucacagcauaucugcaggcaggaggcagacuccuccucaauccuuuuuuugggguaggacuuuguccuugcucagucuaaucuggagacucccucagacuuggccagugucuauagaguugaucacuauuaaccaccacaacaucugcuguguaacuucuggggagaugcuacgcacugccuguucaccccagguagggagcccacggcugaccagaguauggauaccaccgaggucuaguguggugaaccagugagguuuauugggguuauuauuagaggagcagagauggcugaauccccaaggcccuccccagcaugggcgacggcucucaaaucugggaaccuagaccacugcagagccuguaggcaguguggcaggcuggagaguguccuucaggguggcucuguucuaauucucuuccaggaaggcugcugaugucagagcugucuaugcaguucagccccccagccuucguugcauuacucuaggggggaggaguguagugacauuuuuaagaauucuggaauuuugguuuccuuaaaaaaaacacagaaaugagccaggcagugguggcacacgccuuuaaucccagcgcucgggaggcagaggcaggcggauuucugaguucgaggccagccuguggucuacagagugaguuccaggacagccagggcuacacagagaaaccuugucucaaaaaaaaaaaaaaaaaacaaaaaaacaaaaaaaccaaacaaacaaaccacacagacauauaagaaugugcuuuuauuuuaaucccaggugugggaugcggggcugcuucgaacuguccccagcagcuaugauuugccucgugcucuagcagaggugugguuuugccagcugcaguucuuuucugagauugugugacauuuggaguucugggaauuuucaucggguacauaaaagugagccccaaccccuaggcaagguuggugauguaauuagggagguugguugcgguuugguugaagaagaaacagaaggaaagaaauuagauucuuggaguuuccugauuucucuccucuauucuuuuuaucuguuugguuuuucuagacaggguuucucuguauagcccuggcuguccuagaacucacuuuguagaacaggcuggccucgaacucagaaaucugccugccucugccuccugagugcuagaauuaaaggcgugugccaccacgcccggcuuucacuuuauuucuuuuuugacaugguuucucuauaugguccuugcuguccugggacucauuuuguagaccaggcuagcuugagcucaaagagaccugccugccucugccuucugaguggagauuaaagaugugugccaccauggcuggcuccagggcacagcugucagcugacucacuguucucucuaccuugauuuuuuucuuuauuggcaugaguauuggccucucugucauaggggugucaacuguguggcuacuaccucagcuccuaccucccuaguagacuucaagcccugccuuugacaguccuugcugugccgugggaugucaggauggcagccuuaguuuuuauaguaacugccuggaagucaguguggaaguggggggcugguagagucugggguuugggucaugcugcaucugagcacugguccaggcaucuuagaguugguuucccaagaaccccaagcccaagacacaucugaguguguaucuagcugugcuguuucccucccgugguguggcuccuggggacagaaagugaacuaggguugaacuggaaguucucuucccaacacuuugaggaaggauaauugugucugucccaaugcagaccgucuccauaagugcugugugucuaggcuggggggaacuguugaccuuggacccaggccugcuuccacagcccagaacauaggguggaugcccagugggcuaugcucagggagacuuguagaggaaaggggucuggaguggugaaggcaggccugggaggggcacuguccacccagcugggcuuuugggugagggugcagacuaaccuucaggguagaugauguugcccucacccauccuggcaugccaaccucacccauccuggcgugccagccagccuccuggagaagugcauagucaaucacccugugaagccccugugagcugcccaccacagccauaguccuaugccccagugaauccuccugucucuggagucacuuguucuggacaucugcuaucacggaggcccacauuguguggccuuuuugugucaggguuucucacugggccgagaugucccuugacaagugucagagccuuguuccuguucacaccugugugauacuuuccuuuguuauguaggugggucauguagugccugucagugucuguuagggucagugccugccccuuuggcugcugggugacuucugugauaaggcugugcaugucugggagcucuugauauuggggugcugggccauugccuggguaucagaccugagcuaagggaagcuucugggauaggccacuggccccaucaacuugucacacaguggcucucgugugggaccagcgccuuccucgaugguaucgugguggcuguugccagucucagggcugaccuucagcucaucggggcaguccaggguugugagguggggcagugcuugggagaagccccguggcccucuuagccuagcccgaggcacguuaggugcuggacuugugccgccucccauggggcuuugcuuguccuggugguccuucuccacuauggccugaaaccaccacagcccagaugacuguccacucccugggauugagccaggugucacaggcaaacaggaggcuccaccagagaugagcaugugugccaugacuagauguaggcuucucacagcaggcagggucagcuaagcaauguccucuguugcagggagauccagcugcugcggcggcugcggcaucggaaugugauccagcuuguggacgugcuguacaaugaggagaagcagaagauauauccuguggguggagugggcugggguggccccuguguuaggggcuggaagccuucugcaaggccucuggcagcaauagugcuacaugucauccuguggugccugucagcucaucaggcaggggagcaaggcauggggcuuccaccuggugccagccuguucugagcaguguggcugggacugggcauggccucacagggacuuggggccuauguacauugacagggccccggcugguucuagagguuuccaugcugccccuucccagagguagagguugcacagccuacguugcaucugggcaguccugggagcauucugagaacccagugcccugcagccccaacuccugguacccaucucucccuguggcuaguacaccagcugauuucaguccuguuguaaucuaugcugacuccaugugguccaagucacugugguggucuuguggacccugugaguacugauagggagcgcagaauggcgggagagcagaguggugguggucuguuggcccagcggggcccuccagaccacuguugcuaggagcagggcuccugggcuuggugugcugcuuuccuuagcgcccuacguauauggugauggaguacugcguauguggcaugcaggagaugcuggacagugugccggagaagcgcuucccugugugccaagcucaugggugagugcccugcugggugcaggaggagcagccauugucaggaaacccagguguuucugggcccccaguuuuuaacccagccaaugugcuuaggguuacccucuuguuaggcccuguggucccgcugcccugcagagccauagugggucugaguccuguucagugcucccagguucagcagaaucacauccccugguuagcagagaacaaagggaagggaagggaaggaagcaagccagaggggaaaccuggcucccugggccugggcagcagugacugccaguugcccuguguaauuuuaguggcccagccuucugacucucaggucuguuugccugagcccuaaacaucuaucaccuuguaggccaggucucaugagucucccaaacuucauaucagacuuauguagguaccaugguaugggcugagacacuguggggccugagccagucccacccauucagguacuuccgccagcugauugacggccuggaauaccuacacagccagggcauuguucacaaggacaucaagccgggcaaccugcuacucaccaccaauggcacacucaagaucuccgaccucgguguugccgagguaggcaccaugugcagggaucaugggccgcuucuccugagcugcccugacucucacugcccugcaggcccugcacccuuucgcuguggaugacaccugccggacaagccagggcuccccggccuuccagccuccugagauugccaauggacuggacaccuuuucagguuucaagguggacaucuggucagcuggggucacacuguaagugucuuguguguacccuguagcagauggggggcuguggguuuucccuaguguucuugggccuuuuugcccacaguguguggcuagcagguuggacauuccaggucugugggugugguuccucacccuaccccaccccacuccacaggguuuugcuugcacacagauguaggugccaugacugcacaucuaccaguuaacauguguccugucugggaguuggggcaccuguccucuggucuccaguguggccagcacugacacucuuuuccuaugugaaguuacaacaucaccacgggccuguacccauuugagggggacaauaucuacaagcucuuugagaacauugggagaggagacuucaccaucccuugugacugcggcccaccacucucugaccuacuccgaggugggcaucucuaaaucacccaaauguuaggacagcaagggacagagccccuggucuggagggguucugaccuuacugucaggacagccuuuguccgccaggaugggagguuucugagauugcuuccccccaucuggggccgggguggguggguggggucucagugcuauggggccuaggaaggccaaggggauggaugcuguaguggugcuguagcacaaagcaggcaccugcuacacucacuuaucucuucuguccuacagggauguuggaguaugagccggccaagagguucuccauccgacagauuaggcagcacaggugagcauggccggccugucucagccugcugggggucugagcugagaacauggucucagaggugcuaggucaucacaggaguaaggaucagugugcuguguguauugaugucugggaaggcugugugugaacuuggggugugacaggggugcccaaugcaggccucccuaccuuuaucauuuuguucaggagugcaggcguuauguggccugagaagcuguagauuucagggccuagaauuagagacggauccucccaugguggggagggaggaguagauggggaagugucacuuuggaucccagcuguuccuuggccaucuggacauggaaaugugucuagggaggccaacaggaagcgugaggcauggugucuuuccucaccugaggcuaagagccuucuggguaacaguggagccucuguccucccuuuguuuauuuaccagcuggucagagccuuuggguccaggcuucucuguccucuucucccuucaugcuagacugagacuggcucagcugggugucccccagugagggcuucuagccuauccguguucaaggcgggugggacuauaggugcagggaccugauugcccacccuaguccaaggcgcuguggcugucaucaguggguggugguuugugccagugcuauggguguuaggcuaccucaagccuguagccggagcacuaaggccucgucuuauguaaggacagccauggugugggcuuugguggguauuggccagccguggucacagugccuggcaccugaugucugugcugcacuuggccuucuuuagcugguuccggaagaaacacccucuggcugaggcgcucguaccuaucccaccaagcccagacacuaaggaccgcuggcgcaguaugacuguagugcccuaccuggaggaccugcauggccgugcggaggaggaggaggaggaagacuuguuugacauugaggacggcauuaucuacacccaggacuucacagugccugguaagcuggcuuggcgcagcuccuacuggagcuggugacuuugugcacucuggggcugguccccuucccaagucuccagccagcuaacaugagccaccaggacugccaaagccauccugguggcuguggcauuucacucugggcuagaugaagggcucccuggcugcaucuagcaggaggaggggaacccuggagggcaguggguaggggcccugagacagccaccugagggaggguccaguggcccucgguccuggccaugccugaccuuauaucgccuucuuccccaggugucgaggaggcggccgaggcagggcuuagcgaggaugcaugcgacacaugcauguggaagagccagggcgcaggccuuccuggagaggagcccgaggagggguuuggggcuuuaguguagcucccugucugcugccccacccauguccuccauaaagcuuuguccacugugucugcagguggaugcuugccgcgacuucccuccugucacuacccugacaggcuccccaccaggguuucagagaacaugccuggguccaaggccugagcuagguccucagugccaggguggccaccagccaggggcucuuggggccuuuguuccuguggccugcaugccagucccacuuagcuccuggccuuucaaauagcuuuggugggaggguaaggaccuugggcuacugugucuccuguagcaauugagaguucuaauagcagugcccgcugggugccagguggaauccacaaggacagguauacaccugauguccaguaugggccuuggccacagcccuuucuaagguuuaaagcaucccuaugugggaauagugucuucuacucugucacguggagcccuugucuagacugucccacaggcugggcuccuggcugagagcugguuucucugcuggggagaagauguacuuaggugcugguugcaugagggacccuuaaggcugcugugguuugaaggaaggcaagggucuggggacacugguuggccauggagcccauuugucaaaugggguaguguugcacagagugaagugaccgugcucugaggauagccugaucccucuguacuuggcaugagggucggacucugcagcaacaggacaggggcuuucuacucagugccuuguguggaggaggggacagaugcuuucucagaguccaccugaccucaagccucagucccaugcagagugagccagagugggugcugcuaguguggccaagucagaggguuugggagagaaauucuggauccaggagcgugggcagugggcugugugcuggguuccacagccgcauugccaagcacuggacuguggaguuacauguagacacugaccucuggagccugggaagcuucaggagaggccaucuuuugucccacugcgagggcaggccaacagagcaagcuggucugcagcccucagcuggaugaucuccuucccggugcucaucgcagcuaguagcucccaggccgaaugcuucaucuccuugugccuguacugagggucuagagccucucccuuggagagcucugugagcuggugcugggcugcccaggcuagacaggcaggugagcgugggcaugcugcaggagggccagggcauagcacugugaaggcagugggccugcuugccuuuggagcuacugagggguggguggcaccagaggcuagagcaccuccgaccagccucugucacaguuggggcuggcugggcccuggggcuuugagcuaccugccccuuggcucaagcuaugcuugccaucuucccguaggacagguccuggaagaggaagugggucagaauggacagagccacaguuugcccaaggcuguuugugugaauggcacagagccccagcucagcagcaaggugaagccagaaggccgaccuggcaccgccaacccugcgcgcaaggugugcuccagcaacaagauccgccggcucucggccugcaagcagcagugacugaggccuacaggugggcaugggccuggguccagccaucccugguguucacagugggugucugcugggcuccuagcuccuucccguagggcagugcugcaagggggaaggucuggugguugaggugguacuaagugaccacccauucuaccaacagugugucaucaggaucucugggcaggugucccugcaaggcuggguuuuccaggccugccuguccacucacuucgggacguuggagccgagggcggaccugcugccccagaagcacuuuaugucgagaccacuggccggccuugccugcaugccgcccugcgagccucgcugucuuuggguugguuucuuuuuuuuuaauaaaacagguggauuuga

SEQ ID NO: 12168 - RNA, 49095 nt, Mus musculus
cgcgccccccggccccgcccccuuuuuggagggccgaugagguaaugcggcgcugccauuggucggagggggcggaccccgagcucccgaggggcuggguccccucgcgccccuauaucacucugcagcccuggacucucgcucacagugggcagcgggcagccgccagcgccaagaaucuucuucucccgcuucuccgcuucccgauccuucuccgggaggccacucguuggcuccgcggacucguguuccagcgacccuuggccacuuaguccugucccgccgggcuacuuggaaggcacuuccccggagcucaucguugcccaccgugcacagugcccgguuaaacccagcgagugagcucggacuguagcaucagcgcuagcgcucggcaacuuugaagaaaagagcggcaguccccgcagcggaccacaacagcuaccaugacucccuggcuugggcuugucgugcuccugagcugcuggagccuugggcacuggggcgcggaagcgugcacaugcucucccagccauccccaggaugccuucugcaacuccgacaucgguaagugcuccggaagacucaguuucccugggcggggacucuguguggggagaugcccugcagagggaacccaaccaguggccuaguggucucuggcgggcgagcgugaacgagguccugcuugauaucuagaaaaauuuccccauugccuugaagggaaaagagcuggagaaggagggugagagauucugaaaaguuggaacgcuaacugaaguucugggaccucgacgacacuuuacaaguuguagucugugcggguggaguugcgagagagaaaacuccuagcuucaaagauugcuuaucucccgcgcccuugaacuucauucuuuuccuugagaaacucagccuagcugcaggcucucccggcaagugcuaauggagcuucuugccugccaaguuuggguggcuggaaaaggggggagggggagaugaaaaaaaaacggggagggggggggcggaaacugugggauugcccuccucccugggagaacugcaucagaguguugauagcuggccugaggugacugugggggaaucacuuaucauagagcugugaaaauucacaggaagauauauuuuuucuucccccggaauguuugugaggagggagagagugaguaucaucggagaaagcagauuugucaccaaaagagcaaagcugccaaaggucucaucgcuuguggugauggucucaaagagacugugcugauuagagggacuugauaagaaguagaacccacuauccagaggaguguuggggacauuaguguuuggagggcuccaggggaaguggaagcuggcuacucucuucuccagcuccuuaaagcucucagguccaauguguguuugcugggcaggggugggacaagaggcugcccuuagccaguguggagucaguaaagaauggaguguguguguuuuaaguauggucauaaaggagauggaaaauuuccacugggucuugagugagggauucuacucugcaaguguguuguguugagaggggggcggggggagggguggugaccuggcaggaaagaaaaccaagguuggagaggcacugcuggugggucggccuagggggaaaucugggaggugguuuugguggucaggucaguccacuuggcagcccaggguguuugugugacccugcagucacccuucuugaagguuuccugggacccagagacacccacccuucucugucccugggggagaaccccuggcuuuauggagugcuugcaagcauccuuuuuuggauugcuggagggcugggaaaguuuucucccuucucucauuagggcccccacccagauuccucuuagucuuuccucccaguagccgaugacuuucucuacuaguuccugcugucugcuuuugcucagccuagagccuggugcuggccugugagcuagcagguggaggaaucugggugugcagucuaugguccaagcucuuuucagcuucacagugggucgaggcguguucaguuugguuugguagugugaguagggagagaggguucucaucucuaaccuagagauuagagguuucggccuugacaacaugagcguguucccagugggcacuccugggguccuacugugggucagacugacaaaguuucuuguaauuucuauggguuuauucaagaaacagcuuuuuuuuuuccuuccucuuaauaugcuuccuagaacaaagucaaauuaccaagaaauaugccaaacccagaacagagagagagagagagagagagagagagagagagagagagagagagagagauccuugcucuggcagggauccaggcucacuaacccucaguuuggugcacugcacaagagaugagauaaugcuuuuaaaaaugggaggugugggugugggccugcuggcuuguugaccugcugccgccugacagcagcaggcacccugccuguugccaccaguagauggcucccaacuguccucgggaaacuggagcucggaaagugugcucaagcccgucugccuccuuccucuuccagaaccuucaagcauucucacucuggccagaugccaugcugccaggcaagggcacagcaugccuagcugggccccugguaagcccccaucaccacaccaaaauggccuucccucucccuguuucuuuauccacgggugucucuuuucucuuuuuuuucuccaaaacccaugggacuggcacaaccuucuggaugaggaggaguuaaaagguguuucuauggcaacugcaggcccuguacccuauuaaaguguuuagaagaauaaacuacacagacgcuuaucagauacacuguggggcaaagaaagagacuuggcagcagucgccucaccuggggccuucuccuuccaguccuugcuccuccuucaaaaccuugacugaagaagcagcggggagggcacugggaaugaaagaggcaggcuuggccaggcagacuuuguucuggccaccuuaguucaggaaggaugggaaauguucagagcauucugaaaacuggagugggguggugugugugugugugugugugugugugugugugugugugugugugugugugugugugugugguuuuggcagaggugggaguaguagagaaaacccccuucucucugucuccauucacaaggaguaauuaggcaguggcauuggugggaguggagaggugucagcccugggucugggaggagcagcugacaaccuuggagaauagcccugauaucauugaguuguuuugacagggaccacugccaggggcguguuccuucagcaucagaucugaagugguuuuagcaaagaagccauuuguagacaaacgugaccuaugcccucucacuccuacaggcagacagacacaaagaaaaugaaauuauggaacuuuggagaauugacaaccaccuaguggggaugguggugugcguguacgugcaugugugcauguccauguguaccaaugcuaauaguaucucgagaauccuggccagaggaagacugcuguuaggcaagaggaaagaagggacggaugcauucagacuugcaugggugugcaagcauguuagagguacuaucuuaacuccccagcaaccuuaagugguauugcacccauuucucagaugggaaauacugaggcugaaugagaucaugcaaggccacccaguaguggccaggcaugcauucagucuucaugaugagaccuuucacuaaccucugacaucuugcacugacuucugacauccuaaggcaggcaccugcaccuggaauccaaaugaaagggacagauggcauuuucaucuagauuagaaaagcuuuccuccaaccuuugaaggcagcuaaaggggccagcaguuuuaauuaaguauccuguuuacggaggaagaauugauuauaguuuuauaacggaacaacauuaaaaaaaaaaaaaggaaauucccuauguucuuuagcuacuaaaaccagaaaagacucucaaaauuauuaggucagagugaaacuaauugugugucacuaagaccagcgaacagcaaggcugauagaauccaaacuugcaggaugacuguaggagacaggauucccaggggauccaccugccagugcugagugggagguggaugaguggagcaugaggcaggaaggaagucugcagacugggguccucguggguguagaaggugccccucugacugaucugucccuuucccaguccccugacagacaagacuagaacagggcugggaaguggcuuugcuggcacagcaggagccauugagcucagcugcugacuggcacauuccaacagguucauuaaugaaaaacaaaaaccauuccaguccccuuuggcuuuuaacacuuuagccugugcuauguggacacgaaggccccuucuaaccacuuuugucacauucagcucuuggguggucucuagaggccaugugggaugguggaagagcccuggacagggcacagcugggcucagauccuccccccuccccaaccccagcaucuuguuggcuuuguguuuaggcuuuuauuggguccuuucagccuuuacucuccucgugaugaaaggacacaguaauuuguacuuucagaccuuuuuuuauucaugccuuuaagcuuaaaguuuuacagugauguguuauuuuauguuuauguaucauuuauccuaucuaucuaccuaccuaucuaucuaucuaucuaucuaucuaucuaucuaucuaucuaucuaucuauccauccauccauccauccacccacccauccacccauccauuuauacauguaccucccuaucucuucaucuacccaccucuacaaaaucaaagaaagagcaagucgcuuuggaucgcugcuucaaucaauacuacuucuuucuauucuccaucugcauccuuacaucauuauccgaggaacauucccagaaguuuugcuucauuagaaaguuguaaaguuagaagacugaauacuggagugaccuuggugucguuucuguucaaucauguauaccagggagugauauacauauacauguggguaauuguagucuugcucuccuuaguauuccaugggaugauaauuuuuuuaaaacccaaugcugaguuuuaagauagaaugauuacugugugcuaggcaucauuccaaauaauuaauaugcauuaguucauucaagucucucaacaguccuacgaggcagauguacuauuaucaucuucacugaaaaaagcugcagcucagaaaaauucaguaaguuguucagugcuauaccugguaaguagcagagacuaguauuuacacccauguaucccaccucucuggugucuccagcuagacuauauaacauuuauagugcuauauguggugauauuacuaugacaauauaauauucauuuagaucuaccaucacuuuauuuagauaucuccuauuuauggauagcuaugcuucuaacaacuuucaccuuccuaagagugcuagaacacauggucacuauauuaucuuuugcugcugugcguggagaagccucuauggcaagcguacauuuggaaguauuggugggaaggaaggacacuguauuuucagcuuugcugcaguccaccgccagagcugcauguugacucuguccuuuuuagguuugcaaucagaggaugggagauggaggcaauagcacaguguugugcugcagauacauucaggcuucucucaaauggaaaacaauuuuagacauuuccuugguauucugacgacuucugcuuuuggucagccuuuuuaucuuuuugaaagggaacaaaauuaaggccacuuaggccaaguuaaugggaucacuuucauaccaagagaaggucuuaagugguaggacagccacagcucuugacuuguggcugggcuacuuuaguuagagauggcuguaggcuuuugcuuuuauaauacguagggcgcuuuucauuacuggaaacuuguuuggacuuugguuuuugcaugaacucagguucaaaagugcaugugugaaacugggacauaggcuuuugugccccuaguugggcucagggugacagcaagaagacugaugccuuuguuccuuccugcagugauugcucaucuggauagugcuuggauggaaaaauaaaauggcugcaaggacggcgguaaauagcugagacagagugggccuggcagagaaagacucuggggucuugacauuaggaaaccugcuuuaagaaaugaucccaccauccugacuagaagucuucaguggguuaaugggguaaaguuauaauaaaauggcuuuuguaaggacugauaaugggcccugcccaucucuucauuggucuuuccugcuuuccuggugauccuguuuucugccggcucuugacccaugcaugcuagguccucccaucauacauccucaugaacuucucauuuucugggucucacuugguccuguuuucugcuaucuguaggacaccauuucuacuaaaagucaacuccucugaaauuccaugaggccugcccagagggcaucaucccaaagccagaaccacaagccugcugaggcaccuguuuuguucucugcuuaugugauaauucuagccccaccauacaguggaacaaacacaacagcaucuuccuaaucagaccuaucauugagguugcaauuacuaucacaacggccaugggcugagcuccucacuuguguaaagaugaggcauuccuucucaugugcuacccacucaguagccucagguugaaaaaggaaaacuuccugccuaacaucagacaagaaacagcccagccugaagcuauaucgccaaagacuguguucaggaucauucucuccuguagauuuagggucucuucuccuggagacuaagaaacgcagcucucuagaacagggaagguccuccuucuuuugcaacaaugugcaacuuuggcacauuggucucugacucacacuguuggaacgcucuggggccauucccuuugacagccucucuggucccugcuguccucaauuucauuauaguguuaguuauuuggaguucuuaauggaaccaagccacacgaaaaauccaugauuucuagccuagaucucuaucuucacccuuauugaauccauccuucuugauacugaaaaauauuuuaaaauccacuucuccaucaguggauauugcuucacagcuucauguguggaguaucuauucccaguccuauaaacaaacaguuuaaaacagaaaauugccacaaugcuagcagguucaaguuggacauauuggcugccaugcuaauugauugcagcccaaaggacgcuugggacucuccugagccuacugaaguguuagaagaguguauagaucucuaaguaaggucauggaccuugucacuucgcugacauuauaccugauguguccaggacuaguggagaagcaagaaguuccugggucccauuguguuggauacccuuugaggauguggccuggguguagcagguugaaacaccaucagcauaauagacuaagcuugggucuagcuaauuagcauauagcaggaggccacaagaugucuccgaacuguggugggaccaaugggucuuuggcucauuuacuuaaugaagugugucuggagaugcagaggggccuggagaagucuucugugcgacugagacagccuggcugccaccaaaggaguagucuccacugcacagcacugcccgacaugcaggucugauuuaaugucacauauuucuuaucaccuacccgugucauucacaucugggacacuagggacuuccaguaguacuaggucugugccaccuggcagaagaaagggugaaggagaagaaaaugguuuggcuucagagagccacgguaaaguucagccagugacuaauagcucugggaugaugggaugagggggugaagguguggggauucagggcaaggguagagagggggagccuugagcagagcaagcucuagaagcacagaucuucaacaucacaagguaguuagucucuucaccccaacuucugcacagcuucuguccucccaggaaugcuugucccaggcaggcaaccuggcuaccugaagagaagucuguuggauucggauaucagguccuugugagacccaggcuagggcaaggggaagugacaagggggaaagugugaugguaagguuucaugagcuaagcugcuuggcuaaguaugcacauuaaaaaaaaaagcaggguggugggagggucacuguucccacuugauggcuaucaauacugauacgguaugugugguuggguagcuaucaauacugauauuggugguauggcuggguagcuucacuguagaguagaucccaugccuucugaagaccaaguccagugguauucauggauuagggguugcccuuccccauuuagacucuucuaagcacauuuccuucugauagguggaaagaaguggagauacuagaguagcugaagggaguguucuagaagcuggugauauuaaacuuggauaacaaaucaguuccuccugucuccacccagcuugggacuagagagcccgugcuuccuguguguugaugugacgagaucacuggucuccaguuaugagaucugaggucugccucaaguuuaucaucugacucuggaauuaccuuggugguaugauccuccccaggaauugaucucucaucuggacaagugaaggacugacugugugugucuacucuuuugugcauggauguuacuuauuacgaugggucaguauucugggucagguuuccuuggggagggcuaucuagcagagcucaggauggaacaccuagugccgccaauaacacucuuugaaggaagcuucauuagaaauauggccugcuaagaucagaucaggaucucuguggcugugaacauagugaggauucuacccaaacacaucuaaugagcugagcucaaugaucuaugggaccaccggacuuccuguuggaucacaucugguuuaccuguagacagcagccuugcagacuuagcuuaaggccagaauucggaaucaaggucgcuucagggucugucacugacugcuggacaguuugguaggaagccuucuaagcugcagaaaagacuuucccacuggaagaccagcuuagauguagaccucuaauuaaaagugauauuauuucauacgagucuguuuacuccaagagagaaagucuggaaguuucaggucaaacaugugaucacugagcaagcccacuccacuuuccucuccaauaaggacaaacagacacccaaaggccugagauuugugagaagcucaacacccaaagggcugccugggauacagaucuggauagauagacaugauggggacuaugccucuugugggcagguggcugugggcuccagauccccuuugacucauuaucuuccagcuuggguuucuuuguaauuaauuaguucagggcacaaaucugaugcugacauugucuagccagaaagggaggguuauuguaauaucaagcacgugagacuauuacuacuaucagcuaaacauauaagggucuccagucucuuguuugccacauuuguccccaaauaucuacgugguggcuuugaguaccuccucuucuccuugauaucagggaggcaauagaacugguggcaacugugaugaacuggaaaauccauguccuuugguaaggggacaguguggccagauguuuagguucuuauaauaagcuggaaaccccaacgugcuagggugaaacuuuaguuuuuaaguguuacuacaauguaaaaucacacacacacacacacacacacacacacacacacacacacacacacacacacaagcauacacugauucagcuguguagguuacagguuucuugugaccuuguaucuggugaccucuugaguaaccuuuaaguccucagaucucagaaugaauauggccaguggcucuuuugaagcaaaaugauuuccucacagccuacauucuugguaccauguccuucccaguuucugagcuggugaagaauacagguugugauguuaaccagcuugccucagaucuugacuuuauuacuugcugguuacaugucuugggcaagccagccuaucucauucuugcuuuuccucucuguuacccugcauguauaagaagaccguucgcuucacagggcuguggagggaauucacugagaucauggaaacagccgucuuggcucgcugcuuagccuguaguaagggcuugguaaauaccaacccucgugauuacgacauagucuuauugccucccuuauaugggaacugggucuuacucacuggucugauguuagugugcacauaguaaagucauugugaaugaaugaggggauguuugaaaaaggcagcauccaguccuucuaggcagcaguguccucagcuugggaguggugggaaaaagagauaguaucagguuuugccaugcagcucagugagaaacagcugcuguauuaaagagcagugaucaacuuggaaaacacagcgaaagaggcugggaaauggcucagucagaaaagugcuugaaagcacagauuccagcacccacauuaaaaacaaacaaacaaaaaacgguauuauggucugauucuaaaaccguagaccugaugcagaguacaaaagaauguccaaggcuugcugaucagccaguguagacuaaccucugaguuccagguugaguaagagaacuugucucaaaaaauaagguagggagcgaaugaggaagauauccaacauuuacuuuuggccuucaaacacacacacacacacacacacacacacacacacacacacacacacacaaaugcacaaauacacauacaugcauauacacacauacauauacauacacacacaaacacacacaaacacacaaauauacauacacauaugcagacauacauauacaaacacacacauauacacacauacacauacauauacacaacauacacacacaaacacacauucacacacacauauacacauacauauacacacaggcacauauacacaaacacacauacacacacauauacauacagcccuccacacacauacagacacauacagacccacacacauacacacauucacaugcagguacacacagucacacacacacagacacacacacaggauggaugaaaaccacagugaccauuggagcucaggugcugaggugguaaagaacaccaagggaugguuuggcagauuaacagguuuuacauauccaggcuggagaugccacacacuccuaaaacuuaaugccucaccugacuuccuauuuuguuuuaaaauuuaacccuaaauaguucacauuccuuugagucucacugugagaaguucccaagcaggaagaacuccucguccugcaccauccgaggaaggagcacggggaaccucccacuccguuaaaaauuuucucauaguggucacuuuauaaaaggaacaagcaagaguuaaugcuauacuuaacuaaugcuaaguuaaugccauacguaacuaaugcuaaguuaacgcuaugcuuaacuaauguauucaaaguaugaucauuuugccauguaaucaauuuuaaauuacuuuugacauuuuuccaguuuugcagugaagguuuuaaaaugcauuguguguuuucacagucagugcaugucaguuauaugcggcugcauuccaguuauccuaccauccacccauuguuaagggcugccaugucaugccgcuaaggagaguacaagccaaaaucccguuugaauaugaggcaucuuuucucacuacccuccguauuuagcagcuugccugcagggugugggaaagauggggaugcauuuuuugcuaaccaaagcucagaagcuacuggcucaauuuggccagaagagacuucaggacgugaaagucccaggcgggaagcucauguccugggugaccuuguacaagcuaucugacucaguuuucucauuugacuaacaggaaacuaggucaacagagguggagcaauuuggcuuuagagauacaccuggaauaagaauaauauuugacaauauuaauauauuaauauuauuaauguguuauuauuauuaauauuauaggccaacauauacucauaccuuaucacuucuaacucuuauuauuagaacauugacauccagaagaguuaaguaucaaggcuacagcuguccuaauaacuuuauauuuuuaugcauggaaauucuauuauuggcuauaagcuuacguguuuggaacuaauauuguugucaucguugucccacuuuuuaggugggaauacugaggcuggaaggggcuugcuagguacuuuuguuaguucugaaaauggugagaggaaaaaccaguuccacaacuuggagccaaauuuaaagcaagcuuuaauuaaauaacagcgaggaagaugggccuugaccaggacuauuccuggguucccagggaauguccacaagucauguuucacagaagcuuaaaaaggaaaaacccauaauucacuguauuucccaucagguucaaucaggaucaagccuauguccugauguauagccugcuuacaucuagucaagcacaucugaucuagucgguucaaacuugcuuaugggagugaaaacacguggcuuguuauuuccaagaaccgcagcucccagcauuccaggaaguuaucuuguccuugggcaagugaggcucacaggucaaccuuggcuuuuacauuuggauauacucaugagagguggagaugggcucugaugacaucacauugucuagguuggaugaugucacaugucugucuagauugcaaggcuggguguggaugucugaauggggaggucuaccccacagacugaacccuuagcuaccgacucccauacucaggcuacccuguucuugguucacacauuuucugccccacugugcucuaggguugagaaaaacagguggggaauucugaccuccaaaacuucuugaaggguccaggcaaagcaaacacuucucaccaggcuuggccaauucccaagcuacccaggcucaggaagccuaaaugcugagccaagcccagcagagugggaagcacacuugucuauccugccugcacagcuggggcaguugggugagcucagcauauaagguuggaaggagguaugugucuaauugcagagggggaggugggauggauuaacacuccuuaaauagacaucagaaagcuaagaauagcccugcugccuggaaaucgcuuggugcuccugaccacaggccaucacacuuaguagcugcucaauaaaugugggugaacuacaggaacacucaaauacugaacuggagucauuguacggguauggugccaggaagauggugcucuguguacaaagaacuucugcccaggcuuaucugaguuccaugaaggccagagcacuuugcuaaccaacuucauuuaccaacuuuaguugucauuauaucaacuacuuaaauuuuuuucuuaacagcuuauaguucagacaccaggcaagacauguucagugugcuuuggcccuugauucugcuaugccuccaauuacccuucaagguugaaaacaugagaacggcuuccuggggucaucaaaacuuugggguuuuagugguggcacacaccugcaauccuagcacucaggaggaagaggcaggaggaccaugaauucuagguucuagccugagcuacacagugaguuacaggcuacccugggcugcacaguaagguuucucccugcuucuccaaagacuuuugcuguucuaagagcaguuugcagaauccaguuccuuguagcuuccuagugucccaucagaccuggugcaggcucuguagcucuaggacccuuccugaagcugccucucugucuggcucagaggaguggaggcggccuuugggguagaaauccaacauuucuuguaggucaucuggguagguagugaggacaggcgcagacaagaguuccugagcuguaugaaggcuuaaguugaucuguguuucuuuccuaaggacauuuauaaucuugagaacauuugucuuggagaauuagacaauaauugugugaggauuaagcagccccaaguaaaauaaaacaaccuccaaggagccuaacuuuacccaaaguuauccugaagggaacgggccugcugauugagcagugccucugguguuuugguaagcaauggcugagagaacccgagguggucugcuaggauucagcugccaugaacauggcucagagcacagcaaggcuggacacuucaaccugugaguacuuacauccauguuuauacgcugagaauuuuugugggacccauggggcagcacagugguuuggaaaaggggucagugcuccaagccuggcucuguccccacugcuguguaacucugccugagcuaccucuccuccgaggcaucuuaaugcaguuaguaucaagucuugagcgccugaguguugaccauucugagucuggcuuuuucaacaggcgaaggaagaagcagggcagagcugacaacagcuggggacagcggagagcuuguccacuguauacucuccuagaguuggguccccuacucgccuucucucaggcccuaggcuuccuggcuggccccuagcuccuguacauuaccuuguuagaagacaaaaaucccugagccauucuaggcagaggaacccaugaugaugaugaugauggcauagaacagaaauaggguggggagaggcaagugagcugcagguagcauuggaggucacaugaaacuagccuggacuggggaggaaaaauucccuaucauguggcccagacacacggggcaguuaggcuguagguuccaauccaaugggucacuggcacgauguuucucuuccccgcuuacccauuccuaauuuccugucuccucuuccucugacaggguuauaaauaacccccaggcuggccucuggucugaguauaggugacccaggugaaaaugaggggacuggggacaaggcagaacugaaccuugccuccuuagucaggagguuaagggguuucagauugcucagggggaauuuugcuuucucacuuuuuuccacuacugugugagggagcaaaagcagagaugaucccugcuggcaccgggaggccuggccuccugggcuggugcuggguuacacaggcaaggagcugccucugugcuuguugcaggucucccagccaaagagcuggaaagaggcuuaaagaggaggcaucuuaggacacacagaggacagcgugccagacuugucaggagcugagggcuucugcccccacccuagccuggucuccugugugagacuacacgugcagaagcugugucuaacuucccaucuucuuccucagccacuggcacauugucagucuucugacuacuaaaugagagggggcugucucuaguccagaugcuacccauuuggcuggguguaugugucaaaggcccugauaauauaugaaugaagauuuucugaacuccucuuacguuccagacauaggcaaagcacugacgucuuuaaugaacauauuacuaucacccuaccuuuuagggguucaagcugucucccuacuugguguaggucuggccaccuuccucuacaguuucugguuuccgaacaugcagcgcacacaaagcuuccuugugagagaaggcauugacuuucugccugauuuccacuucuguucaugguccaagggaacugugggccaccgugauuauuuuuugcagaauuucucuucucuccccacaugguuuucuaggaaaaccaucagcuugauucuacccuccccacacgccaccaagucccagagaaaucagggccccgaaagcaucuuuucaugugguaugugauauacagguugcaauuggucugauuugcuuauuuguauggggacaaaucuccaaggucagcuugagauuucucaacucccaccuggaauuucuagcuuccacaauacaccuccugccucacuacaaaaggcucagagggcaucaccagaaccuggcuacuuccaggagccacggagcaccugaaucucaggagagguccagggcuugggacauguucugggguggagaauuccagagucuugcuuacuuaugggaagcccacacccacagauacugguucuuggcaguagaaggaagaugaccgcugaguaugauuauuguguggacaagucaaauacugcuaauuaagguugucagugcugauuccauaggugauaaagguuagggagcaagauguuaaucagcuucaaaguuccugagcuaacuaugaccaauccgagaaauccaaguggcaccauguccuuucaacacaucucagcccuagaaagcauucugcucugaacucaggaucuucccagugcagaugcaggcauguauggaaaugccgccaagucaauucacauguacucacaguaggcauuaauaauagcaaugaugaagaguucugccuagugauucacuaagggaugcaggaagaugaacugagaaugaaggacaguugagacugaaccccaacucugcuuuuuaucaucacgagacuaacgugugcaucugagccuugguucugccagugacaacaaaauaggaaagggucccguuucuaauucaggauuggcuggugggaagguaggugagagauggcagccaugaccggggcccuccauaaaugcugagcugaagcugcaucugagaaguguguccuugacuuccuccuggccauuacagucuucucagugcauugcugguaccgagggagguuacagaaggcuuggcgucacccuagcgaaggcagauuuuaagaauuucuagaggcaaguucaaaaaacaggcaaauggugggcacagaauguaagauucagugcuuugggaucaggccuggcucugaagucacagaaacaagaaauucucaagggaaacacaagcccagagguggcaaacucuuuccuggggucacuagcuacauggggagggaaguaggcaguuuccugagguuagauuccuuccuggacauuugcaacuauuccauauagcgccucuugccagcauaucacaccacccagcccacgucggcggagagacacuuuuacggauccauagagaagaagagccuuaaguggcucuugauacguccuaucuuucacugcccacuucugcaccagcaaaaggaaaaaaaaaaaagcuagauccccucccaucugcccacccccuuccuacuucccagcagauggcucauuacaggugcugauugcuucggggauuuccagaugaugccccuggacuuggcagagcuguacggggaauccacagauaugggucuccccuucacaggcuacugcuaagaaaaguauuauccccacugggaaagucauccugguacuaugcauccggggcucccaaagugugcaugccguuuaacaaauaauuguauuucuagaauuuugguccaaagaaauuacugggcgaugccuaaaugucuccuacagagauauuucuuaaauaauguuauuaaauauuauuaacuuauucauaaaauauuuuacauaguuuuaugaauauuguauauaaauuauaauuaaaaauuauuaacauagugggccaccuuugaguaauaguaccuugguacaugggcccuugggccaauuuugaguaauaguaccuuguuuuuuuauauuaauaaaaggcaggaguguguauauacagaugcuuagaaggaugucugucuuccagaauaucagcacuguuaauucauaggguguguaguuuuggaugacugucauuuggcuuguauguuccagaaaaugacauuucacagcugugacauguccuuuuuacaaucagauaaaagaacaauagaugggaaguuugcuccguagauccuuugcacauggguagagggcuccauggucaguggaagccagcacagccugcuucuucuugggguacucuugaggaucccgggggccucucagauuuuguguuuccugagagccaugauuacucuguagaccuggagucuguguggcuuucucugagguaccugccacaagagauuuccaaauggaauguuccuauaggguuggaggggugcgggcgggcugacgggcagguugccucugcuucucuccuaaaugggccagcucugugacuaugaguuugccaaaagacugucagggaaaucgggcuuuugagugcccucccugucuaagucuagaaguauccagaguccagcggacuggucuaaagcuagcccaggccuagagggggguaguccuggggaagagugaacaccugccaggaggggcagcugguggaggaggggaguaucucaaaaaaaaaaaaaaaccaaaaaacauaaggaaccuuggggguuggguucugggcagacaguauggugacuggcuagggccagagaaaacuuggcaagcucucaaagggcuagugaguggccaccugggggcugggaggguacucagagugaaaagacuugguccuuauagaaucccauucccccuccuccuccacugucacuggcaucuugggcaauucacuccacuccaagaguccuaccucuacaccuguacaggugaaggucacugucauauauauagauguauguguguguguguguguguguguguguguuguugagcagcuuaaauuaagcaguuggguguguagggggaguaagcagaaagggcaccauugcaagacagcuuugugcuggaucaagaacucaccuuaucucagccaucacuagaccccugauuagagcaagcauaccugggaaucacaagcuggggaaacugaucuuuaaaaugcaggauagaugcauauauacauguguauuacacaauacacagcauguauuauaauacgaauauucuuaggaauagcugaguucagauuggucaggacagaaggucugcuuucaucggcugaauagaguauuagcauggcccucuucacaagagacacccacauccauuucccccauucccacuuaaggaccaauguuucaggcagucgccuuugugauugagcaaagagaagagagggcagcuugccuucucucugaaagggauguuuccugugcacucagcauacuaaaacugcccacuacaggcagagguuuuuaugagccgagaggaucaggaaggcagaaaggaacuuuguuugggaagguggccucaugcugugacuuugugaccuaagugaauaggcuccugguggccucuaaucuguccgggacauugccuccaacuuugaaauaaccaagggggucuugcaagauccacaaggaauagcaaacagacaaacaggcuuuccuucaggcuugucaccagcuggccucugugggagagagacagaggcugcagguagggggacuuuggaagcaagugugagcuuaugggaucugaggagcugugucaaauguucuuuuagcuacauggcacccugagaugucuacagagaacccucugaccccugauuggaccaaguauaccugggaaucccaggcaggggcaucagcugaugugagccaaagacccacugacuucgauucggggacuacuaaaugauguguuuaaagaugggagauagcuucuagguccagguaaaacaaucaaguaagaugccaguguacauaaauaugugcacaagccuauaaacauuuauggauggauauucaugaguauacacagacauuaacauacaagauguuuaucacagaucuuuacaaaaccuuccaacaaacaggcucuugggguuggaucauaugaaugaacguguucggauuggaagaacacggaucaccgacaaauggauucugugcaaugcaagaaaacaggaggcaggcugggaaacuggccaggagaguguggaccagugaccggagcaggaaaaacagauaccuucacuccauuuuauaaaauguuggguaaucucaggaucuauguugcagagauaacaggugacuuaaauccuuaucuuuuuguuugauuuaagccagugcauacauacaggucaccugauuaauuacugucuuuuggaauuuuagguaauacaguauuuuagagagaugaaacaaauuuuuuucuuuguuugcuuguuuuguuuguuuuguuuugguuugguuuuuucgguuuuucgagacaggguuucucuguauagcccuggcuguccuggaacucacuuuguagaccaggcuggccucgaauucagaaauccgccugccucugaaauuuccagauugugcuggguucuggaaauauuuacuaagcacuaaggugucugccccuaagccccccagccugucacucaggagguguccaagugagugugugauccaagcacucuuuucuaacuguguuucccuuuccugcacgacagcucuaagacacugcugucacagacacacauucucucucucucuccacuuguaggagccuggagguacaguugugaauccaaggcuccagucuacaggccagcacuccauaccccagugacaagacaagccuggaacccaugaucugggccguacucccuuagggaugcuggggguuucuaggccacuuuauagaggguaggacucugaaacugcagaccccgagcuaaccugaucuccagcucccuguguuuucuuccuagcucuggcgggggguggggggcagcuggggaggcaggcaugugccaggcgcucagcaaaugguuucuccuuggcaucaaccuugccacauugcuggguguuaucuuacuccaguccagcaccaccagcaaaagcagggccaggcgcggccucacccaaagcucccuguuuaaauauguggauucaucuggacagggacagcugcaucaggcaagcagagucugccaccguacccuguuuccuugaaauccguccauacaggaacacggcucucacuagccuggugccaggcccugcaagcuccuacuugcacaaacggauuaucaaacaugugaccaucuguacccugccuaugccucugugcuuuucugggaguuaggagaaaucuccugugagguuuacagugacuuuagacggcgaggagggaaaagguagagacgaugaucauuaauuuccuugcuuucacuccagcccccaacaauccauucuccaaaaaggagccagagcaagcuauugaaaugucagucacgugccagcaauggcuuguucaaagcucucccauggcuucucaacuccuuaacaaguucuagaagguucuaugggaucugaccucugucuucuugacuccuuuuucauggaggagccuugucuacuccaaccauucucuaugcccucccuccagaaccugguauuguuuugggcauauguuugcuuguucugucucuucuaccauaguaaguccuaggaauguagagaucucacuucuuagaagauuccuggaaggcuaaugcugacugaaaugcaugaaauaauaauagaugggguaaguugggacucagauggaucaagugucuugucuuggguccucagcagaggaaggacauagagccaggcucagacuuagcucugugcuucaguaauuuggguaaaaccccagcagaggaauucuaacagggccauuuagggcagaucaccuuccagccagcaagcuuuguugaugggaaacagaugguucagacaucccagacagacacugggauauucugccaccuguuggcugccgcaucagaaagaggucauucauuugccacuugcuaagcugcaugcaccuagggaggaagggccagaaauuaauucuuuuccucuuggggaguuuucuauaccacaaucaguaacauuucaacuuguagccuuuaaaacuacuuguucaaucauuccucaauucacugaggaagcagggaugagaaaugacuuguccauuggugacaccaagcauuugaaguccaggcaguaaaaucaagauuuccucacuucaaucugggaguugcggucuaccugcuccaugcucuuugggcuggaccugggagaaacaacauccucccuucaugcuacacauuucuucuucguguucggugcaccugaauacuagguucagugcuggcuuuagcagaggggaguggugccagcccugagugacauugaacauccugaagaagucggucccuugaagaaauucacacuuguccauuccccuuggggucaggaaggauaaaaacagcaucucaggggcaacuggucuuuacuuucccacugcuccagggguauccuugagggcugaagaagacuaucaauucccuucuuauaauagacuuagacuugccugaaaccugucaagucacaugucacccagucuaccucuccaaguauauugcugaaaugggacagggacaaaauaggaucugcuaaauucagcuaggcaacacuuagaggucugucuagccacacagcugaccccaggcuuaagcacaagaggcaggaacuagauugaacacuaaauuggugcuaccuuugaucugagcauccuuucaugaccaugccugguggugcagagcaugacuuuuccuguugcuuccucaagagugccuguaauuguuaccaaccugucgaccaagcaaagaaacauguccccuuuuugcucagccagcucccauuaugacuaagauaaagugggguugggguacagcccagcccucaggccuucagcuuuucacuugcaccucuaugcaggcuugcuucucauccugggagaugacuggugccagaugcucccguuagccagcaucuucauagcagcaagggcacuggccuccugauucauaaagagugguccugcuuuccaucagacccuaauuggucugggucuggccuucaccucccacagaaugcuggccacuggcuguuccuuccuccagccagaacaaugccuggcucuggccacugacccuggcccaagcaggccugccaagcuauggcucucaaaccuaacuuuguauuaucaagauuggcuucccacacccacacacaauguuguuggaaggcagguuuuuggaaaggcuaagcacacgcacuaacauacuauuuuggauccauccaaaugcuccccacucccaggaaggagcaagaugccaccuggaagacuucaaucacaaguuagcauuuguauccauguuuccucucccuucucuugcugggcuuuucuacacuguccacuuggacagauaccagccaaugucccgagcuucuaccugaccugaaaucaaaaugugcuggccaagaguaaguggggcagccgccauuccaugagggggaaaguuggcagccaggcugugagccugcaaugcccauauggggcugagcuagcucucuccauuuucuuuucucuuuucuuagaauguauugguucacuugcuuacugcuucucuagcuucugcauggccuugggaaggaagcuucuuccaaaguaauuaaugcugcugucucccuuaugaccuauaucucaguacucacaccccuauguggugugauuuugcaucuccauugucuuucuuuaauuuucuuuuuucaauugaaaauagauucuucucucauacaguacaucccaaccacagucgccccucccuccaccccucucagcuccccugucuccccauccucgcuccaucucccuuuuucucccagaccccccucccccauuacucuucagaaaggagcaaaccuccaagagccaaacaggacaaaacaagauacaauaagacaaggcacauggccuucuauggaaguuggacaaggcaaucuaacgggaggaaaagaguuccccaaacaggcagaagggucagagauguauccacucccacaauuacaagucccacaaaaccacuaagcuaacagccauuacauacacagaggaccuggggaagaucuaugaggaccuaguguuugguacuucaguuuuugugagcccauacaagcccugauauuuuccccuguguucuccacacucugacuccuacagucuuuucuucccucuucauggguuaucugaucccugggggggaggaaccugauggagaacuccaauuuagacucucuucacauuaaugucugguuguugaucucugcaccugcuccucccaucuucuccauuuuaaguauucaaaggguaagauagauugccugagagaugauacauagucauagcuacuugggaaguggaagcaggcagaauauaaguucaaggccaguugaggcuguaugacaggaccuggucuugaaaugaauuuuuuuuuaaagagcuggagauacagcucaaugguaaagaauuugccuagcaugggcaagguucuagauugaauucucauuaacacacacacacacacacacacacacacacacacacacacacacacacacagagagagagagagacagagacagagacagagacagagacagacagacaaagagaccagucauagacauuguaauacagauucaacuccccaguuuuagguuaccccuaaguccuuauauacuugacuucaacaaggcaugcaccucgcacaguaagaguggcugcuaaaucucuaaaagaugccuagaagcuaccaguuuuucuccuguucuucuuucuucuucucugucucucugucucuguaucucucucuguccgucugccucugucucugucucucuuacucucaguccucuuacugcaauuagcucuaaauaauuggaaauagauaaagcaaauuuaagggcuucccacuggaaaacaccagagcuagcugccccccacccccaucugugucucccagggcugggaauccugcuccuguuuccugugcccagccuguggagucagcuaggcccaggaccccuuccccccacccccacccccgcgcccccgccagugcauagcucccucuguuccagcguucccagcagacucugcaagguguuuccuguggauccucccgaugugcuccacugguguagugcgaauccaauuagaacauugugagcugcuacccacagccuggacaguguuuuguuuauguuuugcucuuuaaaaaaaaaaugaaagaaagaaagaaaucccaccaagggcauaggggugaggaaaacaagggaaaugaagaaaaaaauaauccccaaagugagaccaauuuaaucgcccuuguauuucauaaauagaaacuucuacggcaaggaugugaguaagccagguccaggcuguugggaagaaaagcugagauccaugugacucuggugccuccacugucccucuaggggcggaggcuguguguggugaagggagccagcuugccuucagagcagcuuucucugagggggcucaaggaccauggcaaauaagucaccuacguuauguuauauuugggaggacagaugauggguaauggugucccuguccaugagguaagcagaaggacccaaaggagacaugaguuuuuagcaucacugcacucagagugaguccuuuucaguugagcuccuagcagcacccuggccagucugugugggucuuacuucucauuaccaaauggucucugccacuuugaauggcagaaggacccagggagcugauuagggacacuccuagcccaagucuacauaaguucaaaccauggagauggggaauaggccaagaaggacccuugagacagggccagacacaccgcagugacgucgaugcucagaaguaugguucuacagagcauagaaugcacggcacaguggauaaugaccgaugagaagaaagucuaacaaggaaaaaagacgccuaaaugagaaauacaaaggacuaauauccuaggcaaggccccgagagaguaaggggcaguggaguauagcuuuuccaacgugauuuucacauagaauggagggaucugucaacauaggcaaaacucacacagaaaaugaauggaaggcaaagugaaacuaguucccaagugccccuacuccaggguucuuccugccacucagugcuuguuguauagugagguucucccuccuauucucagauccugcaguaguaacaggaagacucaguaaaucacaccagaaguugggaagcagaaucuguuuugaaaacacuagaugaugaugaugaugaugaugaugaugacgacgacgacgacgacgacgacgacgacgacgacgaugauaaugaugauaaugaugauuauucaauuuugcugugguaacacuuaagaucuacccucauaacaaauuguccacacucaagauucuaaguagccaagggugauguuuuagguugaauggccauaaguaauaucauccugaauagggaagcuuugaccuuuguccacuuugugcccugguggauacgccucccgcucccagacugucuuccugggaaaucugcauucauucaacucuuaccauggcaacuagagcugaaggauacaaacaagaagagaaugauggggagaccgggaacgagggccacaggcagacaaggggcccucagaaucugugacaaugucuauucugacaauaacuuauggaaaaugcaagcacucuucugauguguguaugcccaccacgucagcuaauuagaagaagguuaccauagagagagauaauacaauaguuaaaaaaaaaccaaaccaaaccaaaacaaaacaaaaaaaccaaaaaccaggaaagccuggcuuaggucacagugccccacaccguacagacuaacucuaggauugucauggcaggaaaguuauucucagugauccugcaaguucugucaguccauugaaaugugcccaacucaccagugguuaagcuggcacaucuggaagguuaaguaaguguggccaaaugaugauggacaggagcuuuagagucaggccaccuggacugacaugcuggguuucccaauuccucauucgaugaucuugggaaaaaucacuuacucccacaagcugcaaugcugucagauggugcuaagucagcacuuacucuaggggucuuaaugaggcucaaacugggacuguccauauaaaguacucagcacugaucaugcgcaguaccugcauguaaguauuggcaccugcuguaauugauaaugguguuaaugagugacaugcucaaagccaguagauuucucguuauugggcaaaguugucaauaggcuccgcugacgcacuuucuggguucauguuaggcuacauguauccauuauuguaaaagaauauuagcauagcauugggaaugugucccucuuugcucuguauuguugcccuugggagcaucuagaagcagugauuaagugugcuucugcaaguagcuuagcucacuucauaacaucacuuccugugcauagguagagucaaaagcuacgggucacuuagguucacugaggcaaaacaccgacuucagcgacggaaaggagcaaugcccuguguugugcguguuuauaggaugccuuuucugaggcaguugcucuagguuaugggacccuaguguccuacaauaaaguucggucagacuuguguccaguuuaucacaucaggccucuuucagaaugcguuugugcuguugacuaauggaaaccagugcacucugcauggcccauaaaaccagaagccauccuagaaccuagaacgaaucuacaugagcucuggaaacuggauccaauuuacaguagagucuuuagacaccgugagggcuugaaggagcugaguccuccugaaagcucucagcagcuguggcacaguggcccuucccugagucuucagccuuggcagucuccuccaauuccucauuucugaugcaucugaccuuuugguugcacauuccauguuuguuaauuguugaguaauagaaaaagggcgagcucuggggcugggugcaucuguauuuaauuucuaguugaugaccucugacaaguuccucaacuccccugagucuuuuuuuuuuuuuuuuucugaauccaauaaaaaaaauacuccgauuaguuuuaaggagcagauauauuaucuguagggggugugucuagcucccuauacuaugugacacaguaccuggcauguguguaguagaccaucaggagguaucugcugaaugcagagaggguuaggugcagauguggguccuauacagauguugaugggauagaugcucuuuucccucuaucacugacacuucuccucuucaauuacacugaccagaccaaggaagaugguucagaaauaaacggugggaguuggcuuuauaauucugucauugccuaccaugaccagaagaggcagcaguuagugggcuuugacuauauuuuguuuaaaguagguggggcuugaagaggcccuuggagcugaucucagaacauuccuucacacccuccaugauagcuguuucugauuaacugucuuagauauuacacacuuagaguuuuucucauaccuguucuaccugaguguccaucaugcccugggcgugggaguugugagcugggugggcugggaccagucacacuuguuuccagugggauccuccuagcuauuuccaccagcuauucacuaccuugcuggcauguagaaacagagcagacauuucugaaugcucaaaccacaguaacaccuccugcuccuccuggugcuuucugggaacagaaucgcagucugcaggucugaugugcagaggggaggucccuuggcuuaauggugguccacuuccuagaccuuucccagaaucccucagcuuuucucgcaaacaaaaucccaauuaggaaaaaaaaaaaaaccaaugcuauggacagccccugagaugcugcccgcuguucugcucucagaaacggcccgaccugaaagcucaaauguucugagaaccguuggagggcacgguauuuuucugggcacugcuucaaaggggcugugguugaagaccgggcugcuauucugguggccacuugugugggauaaaguuucccaugggcccaugggaagggguuggagcccaagagggagggugagggugguccaagcccccuugccaagugugagccaauggcaaagagcaagugggcaguccugaacccugagugaguuugagcuuggcagaagucagugugcacccaagacaccauaucuucucuggccacagcacagaagaccaaccaaacucccaagacaaagccacuccaggaagauaagggguuugaguugcggggagaguaugggaggugcagaggguauauuaaaucuuaacuugaaacuucagcaguggguugcaaagugcaagaagccccuugugggucuuguguaaagagggguaugcaagacccaaaccagcuucuugagguaucccagagcuuuggguggggcgcucccuuaagagcacaguucuaagaguugccuucccuugaagaauugaugcuugccuggaggaucagucccauuacacccaggcaguggguucuguuacucuguauaggcuaagaucucuagucuauagguuuuuaccuucauuuauuccucuaucaauagggccgauccuuuguggcucugagugacuucucagagggcagcuggaguaggaugccaccucuagccgguggaguuguggucccaucuacuuccaucuucuugucucaugggacagaaagaagguuccugaagauaggagccuugcccaccuguuuacugccagaucucuaaggcauggugcuggaucauagcgcucuauagccuucugaguaaacacugagcagcuaauagagcaaccccaagugcuugugggagaagaagaggagaaagaagggaaggggcagaagaaggaaagaggagcacagacagggaaauaugcagaaauccacaggaugggauguggccugaacaagcugaaccugcuuuuccuaccugccaaggcugcugcaaggggaucagcaggggcaggcccggaagagcuuucugugggagcuuuguuuaggcuccugagccugagucucucaucucucauggggucugagugcagcccuuccacagagacagcagguugacugaggccucuuguaacaacauccucugacucacuccuccuggagugccaaucuuccuguuugggaccagggucacuucuuggacacauucacuuucuucuuccuucuucccacuucuuccuuuuccuccuccuuguccuucucuuccuccuccuuccuccuccucuuccuucuucccccucuaguuucuugucuaaauagcuguuaggaaccaggacucuugacucucuacuccaggaggguagaugugaaaacaauccuguauuacuuuccccagccucauucauucacucauucacucauucauucauucauucauucagcaaacacuuuggggagccugcuacaugguacgcuugaugucgagugccgacacuccagguuuuaccugucaucugguuacuagggaugcugcucagugccaaagaacucaucauagaagaaaaauccccagaaggaaaagcagaguauugggacagaagagaguagccuggccugcagagacaggcuuccaaggggaggcugcauuucaguuaaaaggacccugauguguagauacauucaugggaaggagguagaagcccacgaagcaccuuccuggugccuugcaaacuuacgccacagaaauaccaugugcuuccucagauuggaugcccuugcucccagcuaagucaacuuuauauccaggaaccagccaccuuaggacuuuugcccuguccuuggcaaaaugaugcauauaucuuucucccaaauugccaguggcccaggaagcaauuaaggauggcugccuuuaaaagcaagugcauuaauccaaaccucagaaggugccugaggcugacgaccccugccauuugcuucuaagagcuucacaccgaggucaucgcugugacuaggaaagcaggagcaugcuggagguuuuguuuucuguuccuuuggggugaccaaguuccaggcaaucugaccuccuggaccuggaccucucuugccucccuuccauggccccuuuaguucauacacaaacaaugucaacaggggcuguuuccugguuucugacucaagcagacuugcacagugccuacaagacacaaauccuucuucccugcugcuagaggcccaaggacugagaacugagcaccccaggccaggccaggcuuucccagagaccacggagcagaaggaggguaccagucaccaaguaccgagccccgugagcucuuggguggggagguuuuaauggccuucccugagauggaauugggcugaaaugauuugcagcuuucuagauuuucuaagcguguguggaucggguuuauuuuuagccacaggcauucauuucuugccaaaaaaaccugcuuaaauaaaaccaagauuaauauuuuuacuuaacggaaagaguuagucaggacaagcuuugaacuggagccugcuuaucuugacggggggagugcauuuuauaaugucuggccuuggcuucaacaucaacaaaaagggccuuugaaacugacaagggagaagagcccuggggaaccaggauaggauguaggaagugccuauuuggggggaggcagggaaggaggggugucuuccuggaaagugggaagaaggcccugguuuuacaaggagccagcugcaguuuugcuucauucccagccaguuccuugcccuucccccuccucccaaagccugguccaaauuucugcuuccuuaaauucuagaugcaucaaacaaggugucuucugcaggauggguccagaacagauguuucugaugucccuccccacaaacagacuccacggucuugugucaugggagcugugacccugguuccuucgucuguguuugccauucuuuccuaucauuguguuucuccugccuugggacuuagaguucuuuggagccucauuuuucucauuauuccccaagucaggcaccggccucagucaauggugaauggacagauguuugccugaccuaccaacugagaauugcccuuaucccauuuugauggauugaaagcucagaaagaguuggcugucuuccccagucuacacaagagaguuacuuaucugucuuuaagucauccucuuuuuguguggugcuguauauguaaaaaucacacugaacuuaguguauucagcucaaauguauuagaagccugugauguuucagguccuccugguuucucugaguagggcaguuagccagaauaaaaguccuuuuugggagccugcauucuauugagaaaauacaguuaaucaacaaacaaguggccuaaugguggcaggugucagcuagaacacaaugaggcgagaaacaugauggggggacuguggacuuggggagaaggaugcagggagggaacagacauggcagccugaccaggauauagcaaauagacaaugaaaggagcuaugcaggagugaagcaaguguccaacccuagcaacugcgaagggaaagacucugggcuguguguuuggagugguggguacaggaauggagcaagcugccauuccccgagacagagaaggcccucagaggcccaguuauggguguggccuguuaucaggagcucagcguuggauaaguaccucacacagcucagcagacuaucaggggagagcaccauagaaaggcauagaagucauggaaguucuggauugggguuuccaagcaguuggucauugucacuugcaugggcugcauagaaaaccacaguugugaguaaagagaaugauuaaguaggaacacaccauugauuggacugggucucuuggaugguaugggucauucugaaaacuggcuucggugaggugaggagaaaacccaagucaccuuggaggaagagcaccagugagcuugguaaucacuugccacuguuuguaugccgggacgggaaguggccugcaggaggucauccacugacagaacuaaggugccuugugccuucuguuaucucagguuaccaucacggauucccuagauauacguuuugcucugaccuucuggcuugagccauuuuauagggauuuuuagggguugggagaguggcacccacaaggcugagcaccaggggaacccaggggcuucuaggccucuuccaucuucauuccuacugucuuguccucaaauguagauacauccaggguccccaaaggggcaacagguucccaggaaggaccuugaaaaggaagggggaaggaaggugccauguauccucggggaagguuucuguuuuccucuaaugagccacaaagugcuacaaguuugcaagugcuguccagcccccuccccacccuccacccccgaauuucugcucagauccaggcugcaaaguacuuuauacauacacauuguccagugcugggggagaacaauaagcuaaguaaaugauucaccauucauuaucuguugauggugacuguagauucuugcuacuaaucagagagaggggaaaaagggaaggggagaggagacaagacagagggagggaaggagggagaaagggggaaaaugagagagagagagaauaaaugaaugugaagggaagucucaagauuggggacauaucaggcaucccccaucuaaguauaagacuucucuagacccacuaggguugacaaugggugcaggguucaguuaggaacuguucugcaaagauucaauggcagucuucuuucuuggguggggggcuccacaauaguaugcaaagcugcucaguagguacuaauaacagguacagugauucccacuucccagcaucaccccagagggaacacagugaaaugugcacacagcacuuggcacacaagucauggucugucagugacagcugcuaaagauacguccuagcuuuuuuccuucacuguucuugcagaugcaaugcaaagagauccaggaacugcugaccaguggggugggcagcuagauggggcaagggauccuugcucugcccuucuuggacaggcuuacacagaguccugucuacccaugagucucuacaucuuuagggcagaaccagccaugugacucuuaagagaggcuauauggagcgggauggcuauuggugggagccugagauaggggaucuccauuaacuugagggccuuuguuccacagagcagucagaccagcagccccacugcuccuccuuccagccggucaguaggaaaacccauccaucaggucaggcggacaaaggucuguguuugauugauggugguuagauugguggagcagggagagacaugggccagguccagggugucuuguccuucuccaaauccguugauuaacagcagaugugggacuccuagagauacaccaguggucugcuugcccuggaacuauuacuguuuaaagcuugugcggcaggggucccauugcuagcgaaagggggcggggaacgaggacaauaacaaucuuaucggcuuguagagcuguagucugucugccuugguuuugcaaacaguaaccaaccuucccagaauguauuacaagggagaaauguguucuaaagagaugugcuuucaugccuacuuccacagaucucugauauauuugaaaaccacauauauuuauuauggcucugugagcuacuucccaggcacccacagccugcucuuuuccuuuuuguggucuguagauugagcccagagcauucuggguaaggcuuccaucauccuucuacauccccaguuucuagucuagucgguuucuucuuaggaacuuuuaaguugaaacuuuauugacuccuuaauuaaucucuuccugucccuuguagucuccaugcccucagaagcagagaagacagcagagagccuuggaagccucguuggcugagucaggcagggccuccuccagcacuuaggucucuuggugauuugguuuucuggugcucuacuccaccuugucucccucuuaggcugcagucugugggagcaggaaauggggcuuuuauuucuuucuaucgccccuaccaagcauucaugcuuccagacaccagcauaggcuaccugcuggagaacauggggugaagaguguauggccacucucuagcaggaauaaagagaaccugugucuggccugguccauguuaaagcugucauuugaagguggagagagugguuagaugcaccaucagcuccaaguugagaagccaugucuucuguugcuguugaagucuuguagaccgccccuccccuucaaccuucuuguucacugugaccccugccugggccacugauugccucuggggaaaaccuuacugccaaauaguacaaaauaacacgcauccaaguugcacaggacaaacuaaaguaaaugaaguuauaauaauucaggaggcaaauagguggauuuggggccggcaaguaauuuaacucuaucugggagcaaagaaugcuguuuaauuuuagguuaguuucaagagauuuuguuuuuauagagaaaacauugauguggccucuacccugggcucucucugcuuccgcaucuaucucuuuggcccauggauaccaucuugucuggcaggucacacuaggucacuguugggcucucuguagcaacaaagugggacacggauggugcaggaguugcuucgauaucaaggccucaugcacacuuguccuggucaccgccugugugcucccacaucuuucccugugauuuuuuuuuuaacaagguauuuauauauaagcuuucccucacuuccaucccagccaggaaucucuccucuacccuaaucucagggaagguugacaggucuuagccgacagggcugaugggugggcagauaucaaaugagguucugguggugguagcaaugcuacugauagugagcuaagagguacuguguguguguggggggguagaucccaugaugcucuuggucuuuguucucggcucucacagcaacuuucugaggacgccuaucaucacucucauuagaugcauuaggaaacuaaggaccagagagguuucagacauccccuguggccacacagcaccauguggugcuaggaucugacuccugccaaccucaggucuucgugguguuucuccacuauucauaagcacaucacuugcaauccacauaaguggcauugggccaagaaagccagagagaucuaagggggaagagcuguggugaggccacacagcaauggugggaucugaaugcugauguaacucccugagcacaaaaaaaaaccucaguguguuuucucuaaacuguucccagaugaaaagguuccaagcucaggccauuucaggguaagaaaagauuuggcugaccuuaugggcagaagcuuccagaaguacccagacuuacagggcaggcuugcuuaagaaauuuuaugcccaaaucaaggugagcuuguugcaagccagaaaaggccagaugcugccauuuaaaaaaaaaaucccucuuaacccuuucccccuuaggcaaagccuuacucuccaguuuacuuucugggcaaaugaaacaggugaacgcaagucacuuuagucccuugagaaucacuugucauguccagguggaucuguuuucagcccagcagcugggcuaguccaaugugccucuaaggguaggguagaugaaagagucccuggggccucugggaagauguugcucucucugucucugucucucugucucucucugucugucugucucucucucucucucucucucucucucucucucucucucucucucucucucucucucuguguguguguguguguguguaaugcccuuuuacauccauaaaggguauucuauucuauguuuacucaaaaaguggguuggaaugagguguguguuugcuccaugucugaaggaacuugggaacaucaauaacaccuuagagcuagagaguuuggcucaaagccaguaaaaacaccuccauucugcaaaguccuagcaggagagcuucagcugcccacuguguccccccccccccccacccccccgcagcagcuccugccucuuaugaguuccuagaauuaggcgaucuuccccacauacacacacgaugaugccuuaccccuuucaauaccugauugacugcucugagcugcucacuuaaaagaacucuaaagacgacuucggaggggaagggugucuuuuacaaacagucuagcagagacagaagaaguagugccuuaaucaucucagucaaagucucacuagggaguaccagacguugccaauucucugcaugucuggagacaacauacauuguucauguguguguguggggaggcaauugggaaaguaagugaugacugaugcugcugaguaugguagguguguauugagugugcuuguugcaggaauccuucuaucucuggugcuaaggaugaugacucuaauagcaauuaucuaacgaagcuaugucaaaggugaaggguagguuucaccggcuucguuucaccuaauugcuuccguuuagagaauauggacuacugcuaaucuuguuuuagggacaggaagccaguauuaaacuuucuuauguaucuuggauuacaacaguggggcugggauggagaccacucauuaggccccccucagaccuagacuugguugcaaguccuugcuuagugcugugcaugcugggacaaugagaaugcugacuugugaugcaaagagagcugguguucaucacaucauuguggaagagccaggacacaaagagccccugaugagacaggggaucaguaagaaagggaugccccuuccaggcgugguucaggccuuccucaaccccucccucucuuucuugcucuuucuacagugauccgggccaaaguggugggaaagaagcuggugaaggaggggcccuuuggcacucuggucuacacuauuaagcagaugaaggugagugacaucauuacuggccccaggagggauuuggggggggggguugccagaagagucguggccaagggaggccaagugguuggaacuggaauguguguuugcucaguguagaauccuccagggagcuccagggagcugcuaaggcagcaggaagacaugguggcugcuugcuccaaagccugcacagguagaguucuuguuaggaagcugagccuuggaaucaggaaccagacagcaauagcuuuguuacacgaugacuaugaugauugugagaccccaguccaaucacugcucucuucggccugucuaacaccucuaagauccucguauugaaccacaugguccccaagagcccuugugaggcaagccaugcugcaccccagagccagugcaagcacuaaggcuaugugggggguguccauuccuccaguauuuacagagauugaguguugagcacaguaauucucuauuucccagcucugcuuaucuuccuacauuggaguucauuaggaauauuugcuaaacauucacaucagcagacuguuggccagcccauuaagguuucuaauccuucccgggaagucuaccauaaggcuuaccauacacugaaaacccauguccuggucuuguugcuacucuucaaagcccauugacuuuggccuauuugcuuccccaggccacagugaugguaaucgguugguggugugggcuugggcuuagcacccuauacacacucauuauucaggcauccuaacuaguaguguccuuucggagcaggagccaguaguaguagcugcugaaagaauguccuuccuuuugccuaagugguauuaaggacuggugcuucagcuugaauaacucagcuguuccucuaccccugugucuuuuaagugccuggcuauaugcagaucuccguguuugcagccuguaaauccacgaggcaguuugccacuuuaggauuauaguuauaugaggggagaagagacaugcacugacuagucacaacuccaagauaguccauaugaauugccugcccuuguacuaguuggugauccuugcagcuuugaacauugagguggggguguuucugacacauccagaacuuggagaauacuucccaucugaugaaagagauagagacaagacccgcaggucugaaaaauccucagaggaggccaguguucagacccagauuggacuugucuugggagugaggggugacucacuccuggguggagcccagcuauccuagaggcugaccuucaggccucuuuauucccugcugaggucuguggcuagaugcacuaauucuguggaaccuguugcucuggcuucaauucuggaaacagucccaggcucuugguuauguaauguucagagucagcccuggccaauugcccuuggcugccugagcuuggucaugagagcagcucaugucuucagacagccgggaggccagcaguggguggaggugggaagccaguagaguauuuaggaccccaagcccuauuuugcaaccucuggugguggggaaaggagagcuagagcuucugaccauaguggaggccccuccccugcuauggugcagcaaccuccauugucaaacacuuccagguuacuguagagaaaucgcugggagacaggaauuccuaaacuggcuugcuuuccuuccugccuucagggcuugggagcccaguuaccagagaccuugcugucagcagaaugccccugguuguugucacacccacuagugggaguuguuuggaggcuacauaacuuucacccaccagccugccagcagccacucccaggcuagccugcucagacucucuguucacuguucuucagcuggguucaugguaucagggugauaggguguucuauauagucaucucucacuuauuucugauuagguucaaugggaaaugguacagucagagucaugcauuuuaauuaagggcagaugagaaucucaaguugaggcauuagggcaccuucccuaagcauauguggcuuuugaugugcagccugccaaaggcguaacaggaguuucuuggaggcgggaagcuuguacaagcuggugagguggacacgacuccccaaaucgcccugcuauuuggcuuuccucauuagccauagcuaaugucuuucauucauuuugguucccuucccagcccuguguuaugacgcacaaaaccugccaaugccuuuuuaucuagagggaccaucugcuugcaugccagagcagguacagauaggaauuugagucugcccauucaucccaguccucuucagccccucugugcuuagcacugauugggcuguaagaugggaagaaaaggacacgcucgucacaauuauuagaugacuuuaguaagcaacguuuauugagcauauucuaugccccacagugaucugcuaagucuuuguauaaauuagccucaugccacguuugucaaacagccucauauuuaucuucuuaguggugaggccacaaacacuugagaguuauguaacaggcaagaguuuaggacuagaaacuggaaaacuauaggguuuuuacuaccuggucuuggaggacaaggagauuaacaaaguauggagccugcaggcagacuacucauuucugcccacugugggggcuccccucaccugcuuacguugaguucccucagggggacuuaaaggccaggauggguuugcugguaugugaucugacaggugugcaaccugcaaaggguguaucagaaguauauucaacugcugaggcuggcacuggucccuaggaggucuguuacaguggauuaggcuacuccagagggucugauauggaagcugggcaaugcgggagcaggauuggaggaacucggagaacagagaacaugagaaagucagggugucugaccucuaaagacaggcacauggucuuccuuccuucucucaggcaugccuuaagugcacacagaccccacaguguguguguguguguguguguguguguguguguguguguguggugugugugugugugugugugugugugugugacaggaggcuuuaaggacauugugggagcuuauuguaaacccuuacuuagagauuagcugggauugaguuguggggcaaagguggaaguuuccagaaguggccucugucauuugugggggccuuaucuccuauuaggaccaugggaaagcaguuuguuuugccaggggcuauuguuugugcaguguagacaagcuuucaggcaggcugcaagggacagcacgugggggacauuaugucccaguuggucccaggaggaucccagggaaacaugugccggucaugcgcuuugcuuguccuaacugggggcaggacagaucugccgggcaauuggaaugugcugggcccuuuccuuagugguuuguggaagcaaacgagcgccagcaggguuuccuccagcugcaggaccccuugaccuucaggccucaggaagccauugucguccaaugccugagacucuuauggugcaagauucuuaucgagcccuugcugagaccuacuguguugucguccacuaagcacuuaguggaaauauuuaccaaaaccugaaaccgcaugaacaguuuaccuggcgcggaagucagggugucuuguucuuugcaggccauggugauggugcugcacacaucaggaaucuuaacuguguuuccuguggagucagauggguaucacccagcagcaagcacaucaucauucuggucugcucccccauagcggacugaacccccacauucuguuacuuguucuguugcaaagcccccaggguagcagaaggguucagaaggugucuaagccaucaggacaggacacucuguaaacaagcagaggccugccucucuagauugugaacagacagccucgugcccuguagaccaccugacucugcuagccaccugccuguuagaagaugaggacaaacaagaugauaauaacaacagcagcagcaacaaaacaaaacccagcccaucagguuuuacguagcuggguauuugugaggcaccaaugggguacgcuggcugguauuaaugaccugaguaacuaauaaugcaugcuaaggaaucguucuacugcaaagcucuuagcauagggcuagugacaaccagauauucaaggcccuuagagagguaagaaccaggccucagugucccccuccaccuucccucuucccugucucacagaugacaguguggccucaguagaucagggcuuguguagcacacagggacucauucuagagucacagaaugugcucagucucuguuaaagucacauggccaggcauuccagucacguugugacacgagucucgcaaaagcuagagaugcgagaagccccugcugcuguggaagcccugggucuuaagcuucaaaggcugcaaggagagauagagacagaugaccguuaagaccacagacuaugcguuaucuugcuuggacuuugugcccacuguuuaccaacugugugacuauagacaagccucuaagccugucuaagguucaggccugaaccuuguaaagugagaccaaggcucuuuccugcccucuaagguccugggcauccgguggcuagauauuuuagcaguaaccuaccugcagugucacuaacccugggcccauauaacccuguagccgaggcuguucuacuuaucacuggaagguuaccaacaucccugcucugugucugcucuccugccacggugucuuugacacguugucaaggaaacauauugucuugugcuucaaauguuuccaagagguguagccacuccgcucagucauguugcagaugaauuuuacauaguuuaaccuaguaauaaugauauccuuaauuaagaaguuuugcuuuggcgggagggcuuuaccuugagcaaagaaacucagcgccacggcagaagcucagaaaaauaagaacuuaagauaaugccugucccgaguucacucuccucuagccgaauggaauuuacauuagugcccccauuggaaaaaauggaguucucaguacccacucucagggcccuugugagaauccugugaguaagaacguugcuacauacaccagccuaucacugagauggcacuugaaggccagcuggcuggcuggcuggcuggccccuugaacuugcauagagcccugggugcuuuucauaguagaugccuugaaucugugaugugcggauguguagguagaggaguggggugcagcagguggauagaacauacauauagcuggauaggaagacaccauccuggcccagggaaaagacuagauggccuccuucggugguguucaggaaacccuguggugacagguucauagucuaccacuguccggcugcacaggggggaccagagacucuacagaacacuacacagcagcaugcagauuggacacugggcucucucucacgaucauguuucuuuugcccacagauguaccgaggcuucaguaagaugccccacgugcaguacauucacacggaagccucugaaagucuuuguggccucaagcuagaagucaacaaauaccaguaccugcugacagguaagugucugcaggagcacugagacuccuuugcucugggguggucugccgaagcuugagucagugacauccagaggguugcagacaccuggcuccucagguuaagggucuggcuugcuuacgcacuccugccuggcagccuuggcuccauuguacaucugguuguguccugaucucaugguaucucagcuuuaacguagcuagaaauagguugccucuucaacagcucuuggcagucaauccauuagguuugucuuguaugacagucugaucuuuaggcugucguuguaguaaugacaacacacaaaacccuaaggaauucucagaccuuugaggccuucagcagagugcuugcuaucucaagcuccauuaucagucuggaaaacagggccagaauucacgucuaaagguguugaggaaggugucucaaacccagggucagugccugcccccuggcaguugagaggucuaacagaaugccugcccccuugccuccuauucuccuccagggcgcguguaugaaggcaagauguacacaggacugugcaacuuuguggagaggugggaccaccucacacugucccagcgcaagggccucaauuaccgcuaccaccuggguugcaauugcaaggugaguucuaggggagggugccaaucuggaagcuuugguuccugcuagcuggggcagacagccuguuggguggugcaggggugguaaggaaugcugcccuggggcaaggcagccaggaaagcucugaagaacgccuuuguucuguauucgcugccugcauggugccuacuuggcagcugcuggguugagagggcucuucaaccuccccgccccucccugcugcucuucaaggccaaugacagguacaagaacuuucaguggaggguucugccaagcucuugugaguggguucacucugacagcugacucaaccagguccagucccuuccccauacacaaggucacgagagggaaccgaaucgcuuucucccccuaauccucauaauaaccucauguguuccuaaucacuauuauuucacuguagaagaaaucaaggcaucagagaucuuugucuaugauccuggguuauauagcuuguugagucugauuuccaacccagggcaguugaacucuaaaaucuaugccuuuauuguuuacuuauguuuuacuuauaugaguacacugcagccacucuugagacacacacuauaagagugcaucagaucccauuacagaugguugugggccaccaugugguugcugggaauugaauucaggaccucuggaagagcagucaguuuucuuaaccacuaaaccaucucuccagucuugcuuuuguuguuugaacuccuccauuuccuacaacagugguagucgccucuucccacaucuaaucugagacucaaaugcugugugaccuggaaugagcuguuuaaccuuucugagagucucuauucaucuauagaggggauuuagaaguguaccaaaaguuuagagacaguaugucuggugcccaguagacacucaaugggagcuuauagcuaguguuauuaaucugguagcauuaaagggcaggaacccccuggguuugaauucagggagggccugccauggugcaguccccuaacuguggcuugcgugucauuacagaucaaguccugcuacuacuugccuuguuuugugaccuccaagaaugagugucucuggaccgacaugcucuccaauuuuggguacccuggcuaucaguccaaacacuacgccugcauccggcagaaggguggcuacugcagcugguaccgaggaugggcucccccagacaagagcaucagcaacgccacagaccccugaacccagaccuuccccaccucaccuccuucccaucccgccgagcgucccagacacuaacucuucccagaugaugacaaugaaauuagugccuguuuucuugcaaauuuagcacuggggacacuuaaagucucugcugucuauggaguugauuuggaaauaccuuccuggccccgccccuaccccuucuuuuugguuuugacaucacccauuuccaacuggggaucucuggugccaagccagaaagaacgaggcauguauacaccucuucuucaugauauauaaucuauauuuuuuuaggaaaacagaaauugaaaaauuuaucccauuggggcauuuaaagcuacucuucuuucuucuuccucucuugaccacauccuagacccaguuccauauacacuucuucaucccaauacacaggaaacauggauaaggaaguuggcagaaguccaacuguuucccaaucagucaaaggcagcaagcagacagacgccagguauuugaaaggucuucuacacagaggauauacaacuguaugucugggucagacagucugucuaugugugcaugucagagggagagaagagacagacuguaggagugggucucacaguuauccagcccugugauacuuggguugaccccauguuucagauccuggaacaagcauccaagaguaacagaacuuucugagcuggcaaaggcuuaaacaucugccuggguucagcaggcaaccugcccgucuguacaaaaaacucaaagggcugagaugaacgucuuuccucuccugccucccaugagacagucuccuaggaauucuuggggaaguuuggcuggaagcuugccaacuguaaguuggagaaacacacaccugacacuauccacagauauagucaaguagauuuggauagagaauacuauuuccaaaguaguguuuagcucaucuagggggauguguuuauauauacauuugcauauacccacgggggauuaugagcuaauuuuuuuuauaggacacagaauucuauucaaugcuguuaaauaugcaaauaguuuaaucuuuuuuucuuuuguuguuugaugggaaauugugacauuccaaguugacuuuuuuuuauuaucugaauuaaaauuugaaacucugaccacacucaguacccuacugucccuauaacugggguuaucugaccauccaucucccuucuuuguucugcuuucuguucggggugcccuucacuuaauugccuuacuggcuggcugacggcaggggagugugaguguuagguuagggccuucucaugaaaggggcaguugcacaguggaaugacuccucuccuggaucuggggacagcauacacuucuuccccagcucaguaaugggugaagucacuuccggagguggucaccucauagaaugaacaugauugguuacugagggagccaggcucugccguccaaauguaggccuuuuguuguguuguauuuuuguuuuuaaauaaaaguacaguauaaauuuuccuauuaaauaagauuauuuuaaguuuuagugucaacauugcaaugccaauaguaggugagaguguauugcacagaguuggagauaguaagguggugacauuuaacacaguuacucugucuuuuuucagauuauggguauuuauccucuauuaguaucauaucguuuucauuccacuuuagaaacacaguuaccaguugagagagagagagagagagagagagagagagagagagagagagagagagaacaaguucuagucuguccccaccccacacauaccacugcuuuguccagguguuugauagaagagcagggcaggaagacaguucaggagaugggugucaaguuuucucuugguugauuucauucccuugcaucuuuccccugugcugacagggggcagaaggcacaaccauuuccauggugugccgagagaaggagcugaggucagcaagccagugguucuuaagagcugaaccucuggcuuuacuguuggaaguugucuauuucaaccucagaguuuccuaauauggcgcuccugaucuaucuuacucaagugcccucccauauguauaccccaacaucuuuuccaucuuaauccagcaucgggccauucucaaucccugguaaucaccucccuuuuacauggacagacuugaggugaggccuaaguaugaggcaccugaagauaaaaccaaugggcagaaccaauggccccagucggcuuuugaggucuuggugagaaguacuggccacgaaagggucuuguguaaaguuacaucaucggagagcgguuuuugagcuuucaauaagcuauagcuuuguuuauuucaccuguucacuuacuguauaauuuaaaaucauuuauguagcugagacacuuugauacuucaauuauaucgugaauguuuuauuuugcuaaaucaugugccauguguaggcuguuguguguacacugugucuaagagaagaagaaaagaaaaaaaaaagaaagaaacccacaugccauuuuuuuuuucugauucaaauucuacaguagaauggagggcagaauuacugggacacaaucaccacucagcuagaauggagauucaaggaaauggaagguacuagaaacagacuccuccagccuccuccccauagaauccuaagggugggaagaagaagaagaaaaaaagcaaaagcaaaacaaaacagaaaucaaaaguacacucaaguucuuguccuguaucaaauaucccuaggucaucugccacccacuuuccaagaccuuucuccuacucaaccaggaagucaugguuucugcaguccagagccauggcaacugagauucuaagcucucuuugucucauccaggcaacuuuucugucucccaaccaaggaauuccucugcucaggcuccuguugcccaggauagcucucuucuauagccaggauguggagcuuaaggagacuccaauguuuacuuucuccaguccuagcucugccauauaaacacugucucauguugugcuucuuaaacgacaaagaacauagugacuuuuggggauagaucugucugggagauaaugugaguccaggaggcauuacucuucccugccucacaucaaggugccauucagguaguuggcucccagcuacuuaacgauaaaaauaucacuuucguauuuguaucagagaaacuuaaaaaaaaaauaaagucugaugguagaaauccaaugaaaugggagaaggcaggagagagaggucucaguagaucuaagucggcuguuuggguugaggaggagagaacccgaggaaaugaccaugcucuggggacagggguaccuuagauucucugucuauuuuuccucuagcaagccagcugugcugaagcccaguagagaugaagagacaccagccagagaaaacccccucuagaaggaauguauuuguugcuaaauuuuguagcacuguuuacaguuuuccuccauguuauuuaugaauuuuauauuccgugaauguauauugucuuguaauguugcauaguguucacuuuuuauagcuguccuuuauucuaaacaguaaagugguuuuauuucuaucac

SEQ ID NO: 12169 - RNA, 49095 nt, Mus musculus
gugauagaaauaaaaccacuuuacuguuuagaauaaaggacagcuauaaaaagugaacacuaugcaacauuacaagacaauauacauucacggaauauaaaauucauaaauaacauggaggaaaacuguaaacagugcuacaaaauuuagcaacaaauacauuccuucuagaggggguuuucucuggcuggugucucuucaucucuacugggcuucagcacagcuggcuugcuagaggaaaaauagacagagaaucuaagguaccccuguccccagagcauggucauuuccucggguucucuccuccucaacccaaacagccgacuuagaucuacugagaccucucucuccugccuucucccauuucauuggauuucuaccaucagacuuuauuuuuuuuuuaaguuucucugauacaaauacgaaagugauauuuuuaucguuaaguagcugggagccaacuaccugaauggcaccuugaugugaggcagggaagaguaaugccuccuggacucacauuaucucccagacagaucuauccccaaaagucacuauguucuuugucguuuaagaagcacaacaugagacaguguuuauauggcagagcuaggacuggagaaaguaaacauuggagucuccuuaagcuccacauccuggcuauagaagagagcuauccugggcaacaggagccugagcagaggaauuccuugguugggagacagaaaaguugccuggaugagacaaagagagcuuagaaucucaguugccauggcucuggacugcagaaaccaugacuuccugguugaguaggagaaaggucuuggaaaguggguggcagaugaccuagggauauuugauacaggacaagaacuugaguguacuuuugauuucuguuuuguuuugcuuuugcuuuuuuucuucuucuucuucccacccuuaggauucuauggggaggaggcuggaggagucuguuucuaguaccuuccauuuccuugaaucuccauucuagcugaguggugauugugucccaguaauucugcccuccauucuacuguagaauuugaaucagaaaaaaaaaauggcauguggguuucuuucuuuuuuuuuucuuuucuucuucucuuagacacaguguacacacaacagccuacacauggcacaugauuuagcaaaauaaaacauucacgauauaauugaaguaucaaagugucucagcuacauaaaugauuuuaaauuauacaguaagugaacaggugaaauaaacaaagcuauagcuuauugaaagcucaaaaaccgcucuccgaugauguaacuuuacacaagacccuuucguggccaguacuucucaccaagaccucaaaagccgacuggggccauugguucugcccauugguuuuaucuucaggugccucauacuuaggccucaccucaagucuguccauguaaaagggaggugauuaccagggauugagaauggcccgaugcuggauuaagauggaaaagauguugggguauacauaugggagggcacuugaguaagauagaucaggagcgccauauuaggaaacucugagguugaaauagacaacuuccaacaguaaagccagagguucagcucuuaagaaccacuggcuugcugaccucagcuccuucucucggcacaccauggaaaugguugugccuucugcccccugucagcacaggggaaagaugcaagggaaugaaaucaaccaagagaaaacuugacacccaucuccugaacugucuuccugcccugcucuucuaucaaacaccuggacaaagcagugguaugugugggguggggacagacuagaacuuguucucucucucucucucucucucucucucucucucucucucucucucucucaacugguaacuguguuucuaaaguggaaugaaaacgauaugauacuaauagaggauaaauacccauaaucugaaaaaagacagaguaacuguguuaaaugucaccaccuuacuaucuccaacucugugcaauacacucucaccuacuauuggcauugcaauguugacacuaaaacuuaaaauaaucuuauuuaauaggaaaauuuauacuguacuuuuauuuaaaaacaaaaauacaacacaacaaaaggccuacauuuggacggcagagccuggcucccucaguaaccaaucauguucauucuaugaggugaccaccuccggaagugacuucacccauuacugagcuggggaagaaguguaugcuguccccagauccaggagaggagucauuccacugugcaacugccccuuucaugagaaggcccuaaccuaacacucacacuccccugccgucagccagccaguaaggcaauuaagugaagggcaccccgaacagaaagcagaacaaagaagggagauggauggucagauaaccccaguuauagggacaguaggguacugaguguggucagaguuucaaauuuuaauucagauaauaaaaaaaagucaacuuggaaugucacaauuucccaucaaacaacaaaagaaaaaaagauuaaacuauuugcauauuuaacagcauugaauagaauucuguguccuauaaaaaaaauuagcucauaaucccccguggguauaugcaaauguauauauaaacacaucccccuagaugagcuaaacacuacuuuggaaauaguauucucuauccaaaucuacuugacuauaucuguggauagugucagguguguguuucuccaacuuacaguuggcaagcuuccagccaaacuuccccaagaauuccuaggagacugucucaugggaggcaggagaggaaagacguucaucucagcccuuugaguuuuuuguacagacgggcagguugccugcugaacccaggcagauguuuaagccuuugccagcucagaaaguucuguuacucuuggaugcuuguuccaggaucugaaacauggggucaacccaaguaucacagggcuggauaacugugagacccacuccuacagucugucucuucucucccucugacaugcacacauagacagacugucugacccagacauacaguuguauauccucuguguagaagaccuuucaaauaccuggcgucugucugcuugcugccuuugacugauugggaaacaguuggacuucugccaacuuccuuauccauguuuccuguguauugggaugaagaaguguauauggaacugggucuaggauguggucaagagaggaagaagaaagaagaguagcuuuaaaugccccaaugggauaaauuuuucaauuucuguuuuccuaaaaaaauauagauuauauaucaugaagaagagguguauacaugccucguucuuucuggcuuggcaccagagauccccaguuggaaaugggugaugucaaaaccaaaaagaagggguaggggcggggccaggaagguauuuccaaaucaacuccauagacagcagagacuuuaaguguccccagugcuaaauuugcaagaaaacaggcacuaauuucauugucaucaucugggaagaguuagugucugggacgcucggcgggaugggaaggaggugagguggggaaggucuggguucaggggucuguggcguugcugaugcucuugucugggggagcccauccucgguaccagcugcaguagccacccuucugccggaugcaggcguaguguuuggacugauagccaggguacccaaaauuggagagcaugucgguccagagacacucauucuuggaggucacaaaacaaggcaaguaguagcaggacuugaucuguaaugacacgcaagccacaguuaggggacugcaccauggcaggcccucccugaauucaaacccaggggguuccugcccuuuaaugcuaccagauuaauaacacuagcuauaagcucccauugagugucuacugggcaccagacauacugucucuaaacuuuugguacacuucuaaauccccucuauagaugaauagagacucucagaaagguuaaacagcucauuccaggucacacagcauuugagucucagauuagaugugggaagaggcgacuaccacuguuguaggaaauggaggaguucaaacaacaaaagcaagacuggagagaugguuuagugguuaagaaaacugacugcucuuccagagguccugaauucaauucccagcaaccacaugguggcccacaaccaucuguaaugggaucugaugcacucuuauagugugugucucaagaguggcugcaguguacucauauaaguaaaacauaaguaaacaauaaaggcauagauuuuagaguucaacugcccuggguuggaaaucagacucaacaagcuauauaacccaggaucauagacaaagaucucugaugccuugauuucuucuacagugaaauaauagugauuaggaacacaugagguuauuaugaggauuagggggagaaagcgauucgguucccucucgugaccuuguguauggggaagggacuggaccugguugagucagcugucagagugaacccacucacaagagcuuggcagaacccuccacugaaaguucuuguaccugucauuggccuugaagagcagcagggaggggcggggagguugaagagcccucucaacccagcagcugccaaguaggcaccaugcaggcagcgaauacagaacaaaggcguucuucagagcuuuccuggcugccuugccccagggcagcauuccuuaccaccccugcaccacccaacaggcugucugccccagcuagcaggaaccaaagcuuccagauuggcacccuccccuagaacucaccuugcaauugcaacccaggugguagcgguaauugaggcccuugcgcugggacagugugagguggucccaccucuccacaaaguugcacaguccuguguacaucuugccuucauacacgcgcccuggaggagaauaggaggcaagggggcaggcauucuguuagaccucucaacugccagggggcaggcacugacccuggguuugagacaccuuccucaacaccuuuagacgugaauucuggcccuguuuuccagacugauaauggagcuugagauagcaagcacucugcugaaggccucaaaggucugagaauuccuuaggguuuuguguguugucauuacuacaacgacagccuaaagaucagacugucauacaagacaaaccuaauggauugacugccaagagcuguugaagaggcaaccuauuucuagcuacguuaaagcugagauaccaugagaucaggacacaaccagauguacaauggagccaaggcugccaggcaggagugcguaagcaagccagacccuuaaccugaggagccaggugucugcaacccucuggaugucacugacucaagcuucggcagaccaccccagagcaaaggagucucagugcuccugcagacacuuaccugucagcagguacugguauuuguugacuucuagcuugaggccacaaagacuuucagaggcuuccgugugaauguacugcacguggggcaucuuacugaagccucgguacaucugugggcaaaagaaacaugaucgugagagagagcccaguguccaaucugcaugcugcuguguaguguucuguagagucucugguccccccugugcagccggacagugguagacuaugaaccugucaccacaggguuuccugaacaccaccgaaggaggccaucuagucuuuucccugggccaggauggugucuuccuauccagcuauauguauguucuauccaccugcugcaccccacuccucuaccuacacauccgcacaucacagauucaaggcaucuacuaugaaaagcacccagggcucuaugcaaguucaaggggccagccagccagccagccagcuggccuucaagugccaucucagugauaggcugguguauguagcaacguucuuacucacaggauucucacaagggcccugagaguggguacugagaacuccauuuuuuccaaugggggcacuaauguaaauuccauucggcuagaggagagugaacucgggacaggcauuaucuuaaguucuuauuuuucugagcuucugccguggcgcugaguuucuuugcucaagguaaagcccucccgccaaagcaaaacuucuuaauuaaggauaucauuauuacuagguuaaacuauguaaaauucaucugcaacaugacugagcggaguggcuacaccucuuggaaacauuugaagcacaagacaauauguuuccuugacaacgugucaaagacaccguggcaggagagcagacacagagcagggauguugguaaccuuccagugauaaguagaacagccucggcuacaggguuauaugggcccaggguuagugacacugcagguagguuacugcuaaaauaucuagccaccggaugcccaggaccuuagagggcaggaaagagccuuggucucacuuuacaagguucaggccugaaccuuagacaggcuuagaggcuugucuauagucacacaguugguaaacagugggcacaaaguccaagcaagauaacgcauagucuguggucuuaacggucaucugucucuaucucuccuugcagccuuugaagcuuaagacccagggcuuccacagcagcaggggcuucucgcaucucuagcuuuugcgagacucgugucacaacgugacuggaaugccuggccaugugacuuuaacagagacugagcacauucugugacucuagaaugagucccugugugcuacacaagcccugaucuacugaggccacacugucaucugugagacagggaagagggaagguggagggggacacugaggccugguucuuaccucucuaagggccuugaauaucugguugucacuagcccuaugcuaagagcuuugcaguagaacgauuccuuagcaugcauuauuaguuacucaggucauuaauaccagccagcguaccccauuggugccucacaaauacccagcuacguaaaaccugaugggcuggguuuuguuuuguugcugcugcuguuguuauuaucaucuuguuuguccucaucuucuaacaggcagguggcuagcagagucagguggucuacagggcacgaggcugucuguucacaaucuagagaggcaggccucugcuuguuuacagaguguccuguccugauggcuuagacaccuucugaacccuucugcuacccugggggcuuugcaacagaacaaguaacagaauguggggguucaguccgcuaugggggagcagaccagaaugaugaugugcuugcugcugggugauacccaucugacuccacaggaaacacaguuaagauuccugaugugugcagcaccaucaccauggccugcaaagaacaagacacccugacuuccgcgccagguaaacuguucaugcgguuucagguuuugguaaauauuuccacuaagugcuuaguggacgacaacacaguaggucucagcaagggcucgauaagaaucuugcaccauaagagucucaggcauuggacgacaauggcuuccugaggccugaaggucaagggguccugcagcuggaggaaacccugcuggcgcucguuugcuuccacaaaccacuaaggaaagggcccagcacauuccaauugcccggcagaucuguccugcccccaguuaggacaagcaaagcgcaugaccggcacauguuucccugggauccuccugggaccaacugggacauaaugucccccacgugcugucccuugcagccugccugaaagcuugucuacacugcacaaacaauagccccuggcaaaacaaacugcuuucccaugguccuaauaggagauaaggcccccacaaaugacagaggccacuucuggaaacuuccaccuuugccccacaacucaaucccagcuaaucucuaaguaaggguuuacaauaagcucccacaauguccuuaaagccuccugucacacacacacacacacacacacacacacaccacacacacacacacacacacacacacacacacacacacacacuguggggucugugugcacuuaaggcaugccugagagaaggaaggaagaccaugugccugucuuuagaggucagacacccugacuuucucauguucucuguucuccgaguuccuccaauccugcucccgcauugcccagcuuccauaucagacccucuggaguagccuaauccacuguaacagaccuccuagggaccagugccagccucagcaguugaauauacuucugauacacccuuugcagguugcacaccugucagaucacauaccagcaaacccauccuggccuuuaagucccccugagggaacucaacguaagcaggugaggggagcccccacagugggcagaaaugaguagucugccugcaggcuccauacuuuguuaaucuccuuguccuccaagaccagguaguaaaaacccuauaguuuuccaguuucuaguccuaaacucuugccuguuacauaacucucaaguguuuguggccucaccacuaagaagauaaauaugaggcuguuugacaaacguggcaugaggcuaauuuauacaaagacuuagcagaucacuguggggcauagaauaugcucaauaaacguugcuuacuaaagucaucuaauaauugugacgagcguguccuuuucuucccaucuuacagcccaaucagugcuaagcacagaggggcugaagaggacugggaugaaugggcagacucaaauuccuaucuguaccugcucuggcaugcaagcagauggucccucuagauaaaaaggcauuggcagguuuugugcgucauaacacagggcugggaagggaaccaaaaugaaugaaagacauuagcuauggcuaaugaggaaagccaaauagcagggcgauuuggggagucguguccaccucaccagcuuguacaagcuucccgccuccaagaaacuccuguuacgccuuuggcaggcugcacaucaaaagccacauaugcuuagggaaggugcccuaaugccucaacuugagauucucaucugcccuuaauuaaaaugcaugacucugacuguaccauuucccauugaaccuaaucagaaauaagugagagaugacuauauagaacacccuaucacccugauaccaugaacccagcugaagaacagugaacagagagucugagcaggcuagccugggaguggcugcuggcaggcuggugggugaaaguuauguagccuccaaacaacucccacuagugggugugacaacaaccaggggcauucugcugacagcaaggucucugguaacugggcucccaagcccugaaggcaggaaggaaagcaagccaguuuaggaauuccugucucccagcgauuucucuacaguaaccuggaaguguuugacaauggagguugcugcaccauagcaggggaggggccuccacuauggucagaagcucuagcucuccuuuccccaccaccagagguugcaaaauagggcuugggguccuaaauacucuacuggcuucccaccuccacccacugcuggccucccggcugucugaagacaugagcugcucucaugaccaagcucaggcagccaagggcaauuggccagggcugacucugaacauuacauaaccaagagccugggacuguuuccagaauugaagccagagcaacagguuccacagaauuagugcaucuagccacagaccucagcagggaauaaagaggccugaaggucagccucuaggauagcugggcuccacccaggagugagucaccccucacucccaagacaaguccaaucugggucugaacacuggccuccucugaggauuuuucagaccugcgggucuugucucuaucucuuucaucagaugggaaguauucuccaaguucuggaugugucagaaacacccccaccucaauguucaaagcugcaaggaucaccaacuaguacaagggcaggcaauucauauggacuaucuuggaguugugacuagucagugcaugucucuucuccccucauauaacuauaauccuaaaguggcaaacugccucguggauuuacaggcugcaaacacggagaucugcauauagccaggcacuuaaaagacacagggguagaggaacagcugaguuauucaagcugaagcaccaguccuuaauaccacuuaggcaaaaggaaggacauucuuucagcagcuacuacuacuggcuccugcuccgaaaggacacuacuaguuaggaugccugaauaaugaguguguauagggugcuaagcccaagcccacaccaccaaccgauuaccaucacuguggccuggggaagcaaauaggccaaagucaaugggcuuugaagaguagcaacaagaccaggacauggguuuucaguguaugguaagccuuaugguagacuucccgggaaggauuagaaaccuuaaugggcuggccaacagucugcugaugugaauguuuagcaaauauuccuaaugaacuccaauguaggaagauaagcagagcugggaaauagagaauuacugugcucaacacucaaucucuguaaauacuggaggaauggacaccccccacauagccuuagugcuugcacuggcucuggggugcagcauggcuugccucacaagggcucuuggggaccaugugguucaauacgaggaucuuagagguguuagacaggccgaagagagcagugauuggacuggggucucacaaucaucauagucaucguguaacaaagcuauugcugucugguuccugauuccaaggcucagcuuccuaacaagaacucuaccugugcaggcuuuggagcaagcagccaccaugucuuccugcugccuuagcagcucccuggagcucccuggaggauucuacacugagcaaacacacauuccaguuccaaccacuuggccucccuuggccacgacucuucuggcaacccccccccccaaaucccuccuggggccaguaaugaugucacucaccuucaucugcuuaauaguguagaccagagugccaaagggccccuccuucaccagcuucuuucccaccacuuuggcccggaucacuguagaaagagcaagaaagagagggagggguugaggaaggccugaaccacgccuggaaggggcaucccuuucuuacugauccccugucucaucaggggcucuuuguguccuggcucuuccacaaugaugugaugaacaccagcucucuuugcaucacaagucagcauucucauugucccagcaugcacagcacuaagcaaggacuugcaaccaagucuaggucugaggggggccuaaugaguggucuccaucccagccccacuguuguaauccaagauacauaagaaaguuuaauacuggcuuccugucccuaaaacaagauuagcaguaguccauauucucuaaacggaagcaauuaggugaaacgaagccggugaaaccuacccuucaccuuugacauagcuucguuagauaauugcuauuagagucaucauccuuagcaccagagauagaaggauuccugcaacaagcacacucaauacacaccuaccauacucagcagcaucagucaucacuuacuuucccaauugccuccccacacacacacaugaacaauguauguugucuccagacaugcagagaauuggcaacgucugguacucccuagugagacuuugacugagaugauuaaggcacuacuucuucugucucugcuagacuguuuguaaaagacacccuuccccuccgaagucgucuuuagaguucuuuuaagugagcagcucagagcagucaaucagguauugaaagggguaaggcaucaucguguguguauguggggaagaucgccuaauucuaggaacucauaagaggcaggagcugcugcggggggguggggggggggggggacacagugggcagcugaagcucuccugcuaggacuuugcagaauggagguguuuuuacuggcuuugagccaaacucucuagcucuaagguguuauugauguucccaaguuccuucagacauggagcaaacacacaccucauuccaacccacuuuuugaguaaacauagaauagaauacccuuuauggauguaaaagggcauuacacacacacacacacacacagagagagagagagagagagagagagagagagagagagagagagagagagagagagagacagacagacagagagagacagagagacagagacagagagagcaacaucuucccagaggccccagggacucuuucaucuacccuacccuuagaggcacauuggacuagcccagcugcugggcugaaaacagauccaccuggacaugacaagugauucucaagggacuaaagugacuugcguucaccuguuucauuugcccagaaaguaaacuggagaguaaggcuuugccuaagggggaaaggguuaagagggauuuuuuuuuuaaauggcagcaucuggccuuuucuggcuugcaacaagcucaccuugauuugggcauaaaauuucuuaagcaagccugcccuguaagucuggguacuucuggaagcuucugcccauaaggucagccaaaucuuuucuuacccugaaauggccugagcuuggaaccuuuucaucugggaacaguuuagagaaaacacacugagguuuuuuuuugugcucagggaguuacaucagcauucagaucccaccauugcuguguggccucaccacagcucuucccccuuagaucucucuggcuuucuuggcccaaugccacuuauguggauugcaagugaugugcuuaugaauaguggagaaacaccacgaagaccugagguuggcaggagucagauccuagcaccacauggugcuguguggccacaggggaugucugaaaccucucugguccuuaguuuccuaaugcaucuaaugagagugaugauaggcguccucagaaaguugcugugagagccgagaacaaagaccaagagcaucaugggaucuacccccccacacacacacaguaccucuuagcucacuaucaguagcauugcuaccaccaccagaaccucauuugauaucugcccacccaucagcccugucggcuaagaccugucaaccuucccugagauuaggguagaggagagauuccuggcugggauggaagugagggaaagcuuauauauaaauaccuuguuaaaaaaaaaaucacagggaaagaugugggagcacacaggcggugaccaggacaagugugcaugaggccuugauaucgaagcaacuccugcaccauccgugucccacuuuguugcuacagagagcccaacagugaccuagugugaccugccagacaagaugguauccaugggccaaagagauagaugcggaagcagagagagcccaggguagaggccacaucaauguuuucucuauaaaaacaaaaucucuugaaacuaaccuaaaauuaaacagcauucuuugcucccagauagaguuaaauuacuugccggccccaaauccaccuauuugccuccugaauuauuauaacuucauuuacuuuaguuuguccugugcaacuuggaugcguguuauuuuguacuauuuggcaguaagguuuuccccagaggcaaucaguggcccaggcaggggucacagugaacaagaagguugaaggggaggggcggucuacaagacuucaacagcaacagaagacauggcuucucaacuuggagcugauggugcaucuaaccacucucuccaccuucaaaugacagcuuuaacauggaccaggccagacacagguucucuuuauuccugcuagagaguggccauacacucuucaccccauguucuccagcagguagccuaugcuggugucuggaagcaugaaugcuugguaggggcgauagaaagaaauaaaagccccauuuccugcucccacagacugcagccuaagagggagacaagguggaguagagcaccagaaaaccaaaucaccaagagaccuaagugcuggaggaggcccugccugacucagccaacgaggcuuccaaggcucucugcugucuucucugcuucugagggcauggagacuacaagggacaggaagagauuaauuaaggagucaauaaaguuucaacuuaaaaguuccuaagaagaaaccgacuagacuagaaacuggggauguagaaggaugauggaagccuuacccagaaugcucugggcucaaucuacagaccacaaaaaggaaaagagcaggcugugggugccugggaaguagcucacagagccauaauaaauauaugugguuuucaaauauaucagagaucuguggaaguaggcaugaaagcacaucucuuuagaacacauuucucccuuguaauacauucugggaagguugguuacuguuugcaaaaccaaggcagacagacuacagcucuacaagccgauaagauuguuauuguccucguuccccgcccccuuucgcuagcaaugggaccccugccgcacaagcuuuaaacaguaauaguuccagggcaagcagaccacugguguaucucuaggagucccacaucugcuguuaaucaacggauuuggagaaggacaagacacccuggaccuggcccaugucucucccugcuccaccaaucuaaccaccaucaaucaaacacagaccuuuguccgccugaccugauggauggguuuuccuacugaccggcuggaaggaggagcaguggggcugcuggucugacugcucuguggaacaaaggcccucaaguuaauggagauccccuaucucaggcucccaccaauagccaucccgcuccauauagccucucuuaagagucacauggcugguucugcccuaaagauguagagacucauggguagacaggacucuguguaagccuguccaagaagggcagagcaaggaucccuugccccaucuagcugcccaccccacuggucagcaguuccuggaucucuuugcauugcaucugcaagaacagugaaggaaaaaagcuaggacguaucuuuagcagcugucacugacagaccaugacuugugugccaagugcugugugcacauuucacuguguucccucuggggugaugcugggaagugggaaucacuguaccuguuauuaguaccuacugagcagcuuugcauacuauuguggagccccccacccaagaaagaagacugccauugaaucuuugcagaacaguuccuaacugaacccugcacccauugucaacccuagugggucuagagaagucuuauacuuagaugggggaugccugauauguccccaaucuugagacuucccuucacauucauuuauucucucucucucucauuuucccccuuucucccuccuucccucccucugucuugucuccucuccccuucccuuuuuccccucucucugauuaguagcaagaaucuacagucaccaucaacagauaaugaauggugaaucauuuacuuagcuuauuguucucccccagcacuggacaauguguauguauaaaguacuuugcagccuggaucugagcagaaauucggggguggaggguggggagggggcuggacagcacuugcaaacuuguagcacuuuguggcucauuagaggaaaacagaaaccuuccccgaggauacauggcaccuuccuucccccuuccuuuucaagguccuuccugggaaccuguugccccuuuggggacccuggauguaucuacauuugaggacaagacaguaggaaugaagauggaagaggccuagaagccccuggguuccccuggugcucagccuugugggugccacucucccaaccccuaaaaaucccuauaaaauggcucaagccagaaggucagagcaaaacguauaucuagggaauccgugaugguaaccugagauaacagaaggcacaaggcaccuuaguucugucaguggaugaccuccugcaggccacuucccgucccggcauacaaacaguggcaagugauuaccaagcucacuggugcucuuccuccaaggugacuuggguuuucuccucaccucaccgaagccaguuuucagaaugacccauaccauccaagagacccaguccaaucaaugguguguuccuacuuaaucauucucuuuacucacaacugugguuuucuaugcagcccaugcaagugacaaugaccaacugcuuggaaaccccaauccagaacuuccaugacuucuaugccuuucuauggugcucuccccugauagucugcugagcugugugagguacuuauccaacgcugagcuccugauaacaggccacacccauaacugggccucugagggccuucucugucucggggaauggcagcuugcuccauuccuguacccaccacuccaaacacacagcccagagucuuucccuucgcaguugcuaggguuggacacuugcuucacuccugcauagcuccuuucauugucuauuugcuauauccuggucaggcugccaugucuguucccucccugcauccuucuccccaaguccacaguccccccaucauguuucucgccucauuguguucuagcugacaccugccaccauuaggccacuuguuuguugauuaacuguauuuucucaauagaaugcaggcucccaaaaaggacuuuuauucuggcuaacugcccuacucagagaaaccaggaggaccugaaacaucacaggcuucuaauacauuugagcugaauacacuaaguucagugugauuuuuacauauacagcaccacacaaaaagaggaugacuuaaagacagauaaguaacucucuuguguagacuggggaagacagccaacucuuucugagcuuucaauccaucaaaaugggauaagggcaauucucaguugguaggucaggcaaacaucuguccauucaccauugacugaggccggugccugacuuggggaauaaugagaaaaaugaggcuccaaagaacucuaagucccaaggcaggagaaacacaaugauaggaaagaauggcaaacacagacgaaggaaccagggucacagcucccaugacacaagaccguggagucuguuuguggggagggacaucagaaacaucuguucuggacccauccugcagaagacaccuuguuugaugcaucuagaauuuaaggaagcagaaauuuggaccaggcuuugggaggagggggaagggcaaggaacuggcugggaaugaagcaaaacugcagcuggcuccuuguaaaaccagggccuucuucccacuuuccaggaagacaccccuccuucccugccuccccccaaauaggcacuuccuacauccuauccugguuccccagggcucuucucccuugucaguuucaaaggcccuuuuuguugauguugaagccaaggccagacauuauaaaaugcacuccccccgucaagauaagcaggcuccaguucaaagcuuguccugacuaacucuuuccguuaaguaaaaauauuaaucuugguuuuauuuaagcagguuuuuuuggcaagaaaugaaugccuguggcuaaaaauaaacccgauccacacacgcuuagaaaaucuagaaagcugcaaaucauuucagcccaauuccaucucagggaaggccauuaaaaccuccccacccaagagcucacggggcucgguacuuggugacugguacccuccuucugcuccguggucucugggaaagccuggccuggccuggggugcucaguucucaguccuugggccucuagcagcagggaagaaggauuugugucuuguaggcacugugcaagucugcuugagucagaaaccaggaaacagccccuguugacauuguuuguguaugaacuaaaggggccauggaagggaggcaagagagguccagguccaggaggucagauugccuggaacuuggucaccccaaaggaacagaaaacaaaaccuccagcaugcuccugcuuuccuagucacagcgaugaccucggugugaagcucuuagaagcaaauggcaggggucgucagccucaggcaccuucugagguuuggauuaaugcacuugcuuuuaaaggcagccauccuuaauugcuuccugggccacuggcaauuugggagaaagauauaugcaucauuuugccaaggacagggcaaaaguccuaagguggcugguuccuggauauaaaguugacuuagcugggagcaagggcauccaaucugaggaagcacaugguauuucuguggcguaaguuugcaaggcaccaggaaggugcuucgugggcuucuaccuccuucccaugaauguaucuacacaucaggguccuuuuaacugaaaugcagccuccccuuggaagccugucucugcaggccaggcuacucucuucugucccaauacucugcuuuuccuucuggggauuuuucuucuaugaugaguucuuuggcacugagcagcaucccuaguaaccagaugacagguaaaaccuggagugucggcacucgacaucaagcguaccauguagcaggcuccccaaaguguuugcugaaugaaugaaugaaugaaugagugaaugagugaaugaaugaggcuggggaaaguaauacaggauuguuuucacaucuacccuccuggaguagagagucaagaguccugguuccuaacagcuauuuagacaagaaacuagagggggaagaaggaagaggaggaggaaggaggaggaagagaaggacaaggaggaggaaaaggaagaagugggaagaaggaagaagaaagugaauguguccaagaagugacccuggucccaaacaggaagauuggcacuccaggaggagugagucagaggauguuguuacaagaggccucagucaaccugcugucucuguggaagggcugcacucagaccccaugagagaugagagacucaggcucaggagccuaaacaaagcucccacagaaagcucuuccgggccugccccugcugauccccuugcagcagccuuggcagguaggaaaagcagguucagcuuguucaggccacaucccauccuguggauuucugcauauuucccugucugugcuccucuuuccuucuucugccccuucccuucuuucuccucuucuucucccacaagcacuugggguugcucuauuagcugcucaguguuuacucagaaggcuauagagcgcuaugauccagcaccaugccuuagagaucuggcaguaaacaggugggcaaggcuccuaucuucaggaaccuucuuucugucccaugagacaagaagauggaaguagaugggaccacaacuccaccggcuagagguggcauccuacuccagcugcccucugagaagucacucagagccacaaaggaucggcccuauugauagaggaauaaaugaagguaaaaaccuauagacuagagaucuuagccuauacagaguaacagaacccacugccuggguguaaugggacugauccuccaggcaagcaucaauucuucaagggaaggcaacucuuagaacugugcucuuaagggagcgccccacccaaagcucugggauaccucaagaagcugguuugggucuugcauaccccucuuuacacaagacccacaaggggcuucuugcacuuugcaacccacugcugaaguuucaaguuaagauuuaauauacccucugcaccucccauacucuccccgcaacucaaaccccuuaucuuccuggaguggcuuugucuugggaguuugguuggucuucugugcuguggccagagaagauauggugucuugggugcacacugacuucugccaagcucaaacucacucaggguucaggacugcccacuugcucuuugccauuggcucacacuuggcaagggggcuuggaccacccucacccucccucuugggcuccaaccccuucccaugggcccaugggaaacuuuaucccacacaaguggccaccagaauagcagcccggucuucaaccacagccccuuugaagcagugcccagaaaaauaccgugcccuccaacgguucucagaacauuugagcuuucaggucgggccguuucugagagcagaacagcgggcagcaucucaggggcuguccauagcauugguuuuuuuuuuuuuccuaauugggauuuuguuugcgagaaaagcugagggauucugggaaaggucuaggaaguggaccaccauuaagccaagggaccuccccucugcacaucagaccugcagacugcgauucuguucccagaaagcaccaggaggagcaggagguguuacugugguuugagcauucagaaaugucugcucuguuucuacaugccagcaagguagugaauagcugguggaaauagcuaggaggaucccacuggaaacaagugugacuggucccagcccacccagcucacaacucccacgcccagggcaugauggacacucagguagaacagguaugagaaaaacucuaaguguguaauaucuaagacaguuaaucagaaacagcuaucauggagggugugaaggaauguucugagaucagcuccaagggccucuucaagccccaccuacuuuaaacaaaauauagucaaagcccacuaacugcugccucuucuggucaugguaggcaaugacagaauuauaaagccaacucccaccguuuauuucugaaccaucuuccuuggucuggucaguguaauugaagaggagaagugucagugauagagggaaaagagcaucuaucccaucaacaucuguauaggacccacaucugcaccuaacccucucugcauucagcagauaccuccugauggucuacuacacacaugccagguacugugucacauaguauagggagcuagacacacccccuacagauaauauaucugcuccuuaaaacuaaucggaguauuuuuuuuauuggauucagaaaaaaaaaaaaaaaaagacucaggggaguugaggaacuugucagaggucaucaacuagaaauuaaauacagaugcacccagccccagagcucgcccuuuuucuauuacucaacaauuaacaaacauggaaugugcaaccaaaaggucagaugcaucagaaaugaggaauuggaggagacugccaaggcugaagacucagggaagggccacugugccacagcugcugagagcuuucaggaggacucagcuccuucaagcccucacggugucuaaagacucuacuguaaauuggauccaguuuccagagcucauguagauucguucuagguucuaggauggcuucugguuuuaugggccaugcagagugcacugguuuccauuagucaacagcacaaacgcauucugaaagaggccugaugugauaaacuggacacaagucugaccgaacuuuauuguaggacacuagggucccauaaccuagagcaacugccucagaaaaggcauccuauaaacacgcacaacacagggcauugcuccuuuccgucgcugaagucgguguuuugccucagugaaccuaagugacccguagcuuuugacucuaccuaugcacaggaagugauguuaugaagugagcuaagcuacuugcagaagcacacuuaaucacugcuucuagaugcucccaagggcaacaauacagagcaaagagggacacauucccaaugcuaugcuaauauucuuuuacaauaauggauacauguagccuaacaugaacccagaaagugcgucagcggagccuauugacaacuuugcccaauaacgagaaaucuacuggcuuugagcaugucacucauuaacaccauuaucaauuacagcaggugccaauacuuacaugcagguacugcgcaugaucagugcugaguacuuuauauggacagucccaguuugagccucauuaagaccccuagaguaagugcugacuuagcaccaucugacagcauugcagcuugugggaguaagugauuuuucccaagaucaucgaaugaggaauugggaaacccagcaugucaguccagguggccugacucuaaagcuccuguccaucaucauuuggccacacuuacuuaaccuuccagaugugccagcuuaaccacuggugaguugggcacauuucaauggacugacagaacuugcaggaucacugagaauaacuuuccugccaugacaauccuagaguuagucuguacgguguggggcacugugaccuaagccaggcuuuccugguuuuugguuuuuuuguuuuguuuugguuugguuugguuuuuuuuuaacuauuguauuaucucucucuaugguaaccuucuucuaauuagcugacguggugggcauacacacaucagaagagugcuugcauuuuccauaaguuauugucagaauagacauugucacagauucugagggccccuugucugccuguggcccucguucccggucuccccaucauucucuucuuguuuguauccuucagcucuaguugccaugguaagaguugaaugaaugcagauuucccaggaagacagucugggagcgggaggcguauccaccagggcacaaaguggacaaaggucaaagcuucccuauucaggaugauauuacuuauggccauucaaccuaaaacaucacccuuggcuacuuagaaucuugaguguggacaauuuguuaugaggguagaucuuaaguguuaccacagcaaaauugaauaaucaucauuaucaucauuaucaucgucgucgucgucgucgucgucgucgucgucgucgucaucaucaucaucaucaucaucaucaucuaguguuuucaaaacagauucugcuucccaacuucuggugugauuuacugagucuuccuguuacuacugcaggaucugagaauaggagggagaaccucacuauacaacaagcacugaguggcaggaagaacccuggaguaggggcacuugggaacuaguuucacuuugccuuccauucauuuucugugugaguuuugccuauguugacagaucccuccauucuaugugaaaaucacguuggaaaagcuauacuccacugccccuuacucucucggggccuugccuaggauauuaguccuuuguauuucucauuuaggcgucuuuuuuccuuguuagacuuucuucucaucggucauuauccacugugccgugcauucuaugcucuguagaaccauacuucugagcaucgacgucacugcggugugucuggcccugucucaaggguccuucuuggccuauuccccaucuccaugguuugaacuuauguagacuugggcuaggagugucccuaaucagcucccuggguccuucugccauucaaaguggcagagaccauuugguaaugagaaguaagacccacacagacuggccagggugcugcuaggagcucaacugaaaaggacucacucugagugcagugaugcuaaaaacucaugucuccuuuggguccuucugcuuaccucauggacagggacaccauuacccaucaucuguccucccaaauauaacauaacguaggugacuuauuugccaugguccuugagcccccucagagaaagcugcucugaaggcaagcuggcucccuucaccacacacagccuccgccccuagagggacaguggaggcaccagagucacauggaucucagcuuuucuucccaacagccuggaccuggcuuacucacauccuugccguagaaguuucuauuuaugaaauacaagggcgauuaaauuggucucacuuuggggauuauuuuuuucuucauuucccuuguuuuccucaccccuaugcccuuggugggauuucuuucuuucuuucauuuuuuuuuuaaagagcaaaacauaaacaaaacacuguccaggcuguggguagcagcucacaauguucuaauuggauucgcacuacaccaguggagcacaucgggaggauccacaggaaacaccuugcagagucugcugggaacgcuggaacagagggagcuaugcacuggcgggggcgcggggguggggguggggggaagggguccugggccuagcugacuccacaggcugggcacaggaaacaggagcaggauucccagcccugggagacacagauggggguggggggcagcuagcucugguguuuuccagugggaagcccuuaaauuugcuuuaucuauuuccaauuauuuagagcuaauugcaguaagaggacugagaguaagagagacagagacagaggcagacggacagagagagauacagagacagagagacagagaagaagaaagaagaacaggagaaaaacugguagcuucuaggcaucuuuuagagauuuagcagccacucuuacugugcgaggugcaugccuuguugaagucaaguauauaaggacuuagggguaaccuaaaacuggggaguugaaucuguauuacaaugucuaugacuggucucuuugucugucugucucugucucugucucugucucugucucucucucucucuguguguguguguguguguguguguguguguguguguguguguguguguguuaaugagaauucaaucuagaaccuugcccaugcuaggcaaauucuuuaccauugagcuguaucuccagcucuuuaaaaaaaaauucauuucaagaccagguccugucauacagccucaacuggccuugaacuuauauucugccugcuuccacuucccaaguagcuaugacuauguaucaucucucaggcaaucuaucuuacccuuugaauacuuaaaauggagaagaugggaggagcaggugcagagaucaacaaccagacauuaaugugaagagagucuaaauuggaguucuccaucagguuccucccccccagggaucagauaacccaugaagagggaagaaaagacuguaggagucagaguguggagaacacaggggaaaauaucagggcuuguaugggcucacaaaaacugaaguaccaaacacuagguccucauagaucuuccccagguccucuguguauguaauggcuguuagcuuagugguuuugugggacuuguaauugugggaguggauacaucucugacccuucugccuguuuggggaacucuuuuccucccguuagauugccuuguccaacuuccauagaaggccaugugccuugucuuauuguaucuuguuuuguccuguuuggcucuuggagguuugcuccuuucugaagaguaaugggggaggggggucugggagaaaaagggagauggagcgaggauggggagacaggggagcugagagggguggagggaggggcgacugugguugggauguacuguaugagagaagaaucuauuuucaauugaaaaaagaaaauuaaagaaagacaauggagaugcaaaaucacaccacauaggggugugaguacugagauauaggucauaagggagacagcagcauuaauuacuuuggaagaagcuuccuucccaaggccaugcagaagcuagagaagcaguaagcaagugaaccaauacauucuaagaaaagagaaaagaaaauggagagagcuagcucagccccauaugggcauugcaggcucacagccuggcugccaacuuucccccucauggaauggcggcugccccacuuacucuuggccagcacauuuugauuucaggucagguagaagcucgggacauuggcugguaucuguccaaguggacaguguagaaaagcccagcaagagaagggagaggaaacauggauacaaaugcuaacuugugauugaagucuuccagguggcaucuugcuccuuccugggaguggggagcauuuggauggauccaaaauaguauguuagugcgugugcuuagccuuuccaaaaaccugccuuccaacaacauugugugugggugugggaagccaaucuugauaauacaaaguuagguuugagagccauagcuuggcaggccugcuugggccagggucaguggccagagccaggcauuguucuggcuggaggaaggaacagccaguggccagcauucugugggaggugaaggccagacccagaccaauuagggucugauggaaagcaggaccacucuuuaugaaucaggaggccagugcccuugcugcuaugaagaugcuggcuaacgggagcaucuggcaccagucaucucccaggaugagaagcaagccugcauagaggugcaagugaaaagcugaaggccugagggcugggcuguaccccaaccccacuuuaucuuagucauaaugggagcuggcugagcaaaaaggggacauguuucuuugcuuggucgacagguugguaacaauuacaggcacucuugaggaagcaacaggaaaagucaugcucugcaccaccaggcauggucaugaaaggaugcucagaucaaagguagcaccaauuuaguguucaaucuaguuccugccucuugugcuuaagccuggggucagcuguguggcuagacagaccucuaaguguugccuagcugaauuuagcagauccuauuuugucccugucccauuucagcaauauacuuggagagguagacugggugacaugugacuugacagguuucaggcaagucuaagucuauuauaagaagggaauugauagucuucuucagcccucaaggauaccccuggagcagugggaaaguaaagaccaguugccccugagaugcuguuuuuauccuuccugaccccaaggggaauggacaagugugaauuucuucaagggaccgacuucuucaggauguucaaugucacucagggcuggcaccacuccccucugcuaaagccagcacugaaccuaguauucaggugcaccgaacacgaagaagaaauguguagcaugaagggaggauguuguuucucccagguccagcccaaagagcauggagcagguagaccgcaacucccagauugaagugaggaaaucuugauuuuacugccuggacuucaaaugcuuggugucaccaauggacaagucauuucucaucccugcuuccucagugaauugaggaaugauugaacaaguaguuuuaaaggcuacaaguugaaauguuacugauugugguauagaaaacuccccaagaggaaaagaauuaauuucuggcccuuccucccuaggugcaugcagcuuagcaaguggcaaaugaaugaccucuuucugaugcggcagccaacagguggcagaauaucccagugucugucugggaugucugaaccaucuguuucccaucaacaaagcuugcuggcuggaaggugaucugcccuaaauggcccuguuagaauuccucugcugggguuuuacccaaauuacugaagcacagagcuaagucugagccuggcucuauguccuuccucugcugaggacccaagacaagacacuugauccaucugagucccaacuuaccccaucuauuauuauuucaugcauuucagucagcauuagccuuccaggaaucuucuaagaagugagaucucuacauuccuaggacuuacuaugguagaagagacagaacaagcaaacauaugcccaaaacaauaccagguucuggagggagggcauagagaaugguuggaguagacaaggcuccuccaugaaaaaggagucaagaagacagaggucagaucccauagaaccuucuagaacuuguuaaggaguugagaagccaugggagagcuuugaacaagccauugcuggcacgugacugacauuucaauagcuugcucuggcuccuuuuuggagaauggauuguugggggcuggagugaaagcaaggaaauuaaugaucaucgucucuaccuuuucccuccucgccgucuaaagucacuguaaaccucacaggagauuucuccuaacucccagaaaagcacagaggcauaggcaggguacagauggucacauguuugauaauccguuugugcaaguaggagcuugcagggccuggcaccaggcuagugagagccguguuccuguauggacggauuucaaggaaacaggguacgguggcagacucugcuugccugaugcagcugucccuguccagaugaauccacauauuuaaacagggagcuuugggugaggccgcgccuggcccugcuuuugcugguggugcuggacuggaguaagauaacacccagcaauguggcaagguugaugccaaggagaaaccauuugcugagcgccuggcacaugccugccuccccagcugccccccaccccccgccagagcuaggaagaaaacacagggagcuggagaucagguuagcucggggucugcaguuucagaguccuacccucuauaaaguggccuagaaacccccagcaucccuaagggaguacggcccagaucauggguuccaggcuugucuugucacugggguauggagugcuggccuguagacuggagccuuggauucacaacuguaccuccaggcuccuacaaguggagagagagagagaaugugugucugugacagcagugucuuagagcugucgugcaggaaagggaaacacaguuagaaaagagugcuuggaucacacacucacuuggacaccuccugagugacaggcuggggggcuuaggggcagacaccuuagugcuuaguaaauauuuccagaacccagcacaaucuggaaauuucagaggcaggcggauuucugaauucgaggccagccuggucuacaaagugaguuccaggacagccagggcuauacagagaaacccugucucgaaaaaccgaaaaaaccaaaccaaaacaaaacaaacaaaacaagcaaacaaagaaaaaaauuuguuucaucucucuaaaauacuguauuaccuaaaauuccaaaagacaguaauuaaucaggugaccuguauguaugcacuggcuuaaaucaaacaaaaagauaaggauuuaagucaccuguuaucucugcaacauagauccugagauuacccaacauuuuauaaaauggagugaagguaucuguuuuuccugcuccggucacugguccacacucuccuggccaguuucccagccugccuccuguuuucuugcauugcacagaauccauuugucggugauccguguucuuccaauccgaacacguucauucauaugauccaaccccaagagccuguuuguuggaagguuuuguaaagaucugugauaaacaucuuguauguuaaugucuguguauacucaugaauauccauccauaaauguuuauaggcuugugcacauauuuauguacacuggcaucuuacuugauuguuuuaccuggaccuagaagcuaucucccaucuuuaaacacaucauuuaguaguccccgaaucgaagucagugggucuuuggcucacaucagcugaugccccugccugggauucccagguauacuugguccaaucaggggucagaggguucucuguagacaucucagggugccauguagcuaaaagaacauuugacacagcuccucagaucccauaagcucacacuugcuuccaaagucccccuaccugcagccucugucucucucccacagaggccagcuggugacaagccugaaggaaagccuguuugucuguuugcuauuccuuguggaucuugcaagacccccuugguuauuucaaaguuggaggcaaugucccggacagauuagaggccaccaggagccuauucacuuaggucacaaagucacagcaugaggccaccuucccaaacaaaguuccuuucugccuuccugauccucucggcucauaaaaaccucugccuguagugggcaguuuuaguaugcugagugcacaggaaacaucccuuucagagagaaggcaagcugcccucucuucucuuugcucaaucacaaaggcgacugccugaaacauugguccuuaagugggaaugggggaaauggaugugggugucucuugugaagagggccaugcuaauacucuauucagccgaugaaagcagaccuucuguccugaccaaucugaacucagcuauuccuaagaauauucguauuauaauacaugcuguguauuguguaauacacauguauauaugcaucuauccugcauuuuaaagaucaguuuccccagcuugugauucccagguaugcuugcucuaaucaggggucuagugauggcugagauaaggugaguucuugauccagcacaaagcugucuugcaauggugcccuuucugcuuacucccccuacacacccaacugcuuaauuuaagcugcucaacaacacacacacacacacacacacacacacauacaucuauauauaugacagugaccuucaccuguacagguguagagguaggacucuuggaguggagugaauugcccaagaugccagugacaguggaggaggagggggaaugggauucuauaaggaccaagucuuuucacucugaguacccucccagcccccagguggccacucacuagcccuuugagagcuugccaaguuuucucuggcccuagccagucaccauacugucugcccagaacccaacccccaagguuccuuauguuuuuugguuuuuuuuuuuuuuugagauacuccccuccuccaccagcugccccuccuggcagguguucacucuuccccaggacuaccccccucuaggccugggcuagcuuuagaccaguccgcuggacucuggauacuucuagacuuagacagggagggcacucaaaagcccgauuucccugacagucuuuuggcaaacucauagucacagagcuggcccauuuaggagagaagcagaggcaaccugcccgucagcccgcccgcaccccuccaacccuauaggaacauuccauuuggaaaucucuuguggcagguaccucagagaaagccacacagacuccaggucuacagaguaaucauggcucucaggaaacacaaaaucugagaggcccccgggauccucaagaguaccccaagaagaagcaggcugugcuggcuuccacugaccauggagcccucuacccaugugcaaaggaucuacggagcaaacuucccaucuauuguucuuuuaucugauuguaaaaaggacaugucacagcugugaaaugucauuuucuggaacauacaagccaaaugacagucauccaaaacuacacacccuaugaauuaacagugcugauauucuggaagacagacauccuucuaagcaucuguauauacacacuccugccuuuuauuaauauaaaaaaacaagguacuauuacucaaaauuggcccaagggcccauguaccaagguacuauuacucaaagguggcccacuauguuaauaauuuuuaauuauaauuuauauacaauauucauaaaacuauguaaaauauuuuaugaauaaguuaauaauauuuaauaacauuauuuaagaaauaucucuguaggagacauuuaggcaucgcccaguaauuucuuuggaccaaaauucuagaaauacaauuauuuguuaaacggcaugcacacuuugggagccccggaugcauaguaccaggaugacuuucccaguggggauaauacuuuucuuagcaguagccugugaaggggagacccauaucuguggauuccccguacagcucugccaaguccaggggcaucaucuggaaauccccgaagcaaucagcaccuguaaugagccaucugcugggaaguaggaagggggugggcagaugggaggggaucuagcuuuuuuuuuuuuccuuuugcuggugcagaagugggcagugaaagauaggacguaucaagagccacuuaaggcucuucuucucuauggauccguaaaagugucucuccgccgacgugggcuggguggugugauaugcuggcaagaggcgcuauauggaauaguugcaaauguccaggaaggaaucuaaccucaggaaacugccuacuucccuccccauguagcuagugaccccaggaaagaguuugccaccucugggcuuguguuucccuugagaauuucuuguuucugugacuucagagccaggccugaucccaaagcacugaaucuuacauucugugcccaccauuugccuguuuuuugaacuugccucuagaaauucuuaaaaucugccuucgcuagggugacgccaagccuucuguaaccucccucgguaccagcaaugcacugagaagacuguaauggccaggaggaagucaaggacacacuucucagaugcagcuucagcucagcauuuauggagggccccggucauggcugccaucucucaccuaccuucccaccagccaauccugaauuagaaacgggacccuuuccuauuuuguugucacuggcagaaccaaggcucagaugcacacguuagucucgugaugauaaaaagcagaguugggguucagucucaacuguccuucauucucaguucaucuuccugcaucccuuagugaaucacuaggcagaacucuucaucauugcuauuauuaaugccuacugugaguacaugugaauugacuuggcggcauuuccauacaugccugcaucugcacugggaagauccugaguucagagcagaaugcuuucuagggcugagauguguugaaaggacauggugccacuuggauuucucggauuggucauaguuagcucaggaacuuugaagcugauuaacaucuugcucccuaaccuuuaucaccuauggaaucagcacugacaaccuuaauuagcaguauuugacuuguccacacaauaaucauacucagcggucaucuuccuucuacugccaagaaccaguaucugugggugugggcuucccauaaguaagcaagacucuggaauucuccaccccagaacaugucccaagcccuggaccucuccugagauucaggugcuccguggcuccuggaaguagccagguucuggugaugcccucugagccuuuuguagugaggcaggagguguauuguggaagcuagaaauuccaggugggaguugagaaaucucaagcugaccuuggagauuuguccccauacaaauaagcaaaucagaccaauugcaaccuguauaucacauaccacaugaaaagaugcuuucggggcccugauuucucugggacuugguggcguguggggaggguagaaucaagcugaugguuuuccuagaaaaccauguggggagagaagagaaauucugcaaaaaauaaucacgguggcccacaguucccuuggaccaugaacagaaguggaaaucaggcagaaagucaaugccuucucucacaaggaagcuuugugugcgcugcauguucggaaaccagaaacuguagaggaagguggccagaccuacaccaaguagggagacagcuugaaccccuaaaagguagggugauaguaauauguucauuaaagacgucagugcuuugccuaugucuggaacguaagaggaguucagaaaaucuucauucauauauuaucagggccuuugacacauacacccagccaaauggguagcaucuggacuagagacagcccccucucauuuaguagucagaagacugacaaugugccaguggcugaggaagaagaugggaaguuagacacagcuucugcacguguagucucacacaggagaccaggcuagggugggggcagaagcccucagcuccugacaagucuggcacgcuguccucuguguguccuaagaugccuccucuuuaagccucuuuccagcucuuuggcugggagaccugcaacaagcacagaggcagcuccuugccuguguaacccagcaccagcccaggaggccaggccucccggugccagcagggaucaucucugcuuuugcucccucacacaguaguggaaaaaagugagaaagcaaaauucccccugagcaaucugaaaccccuuaaccuccugacuaaggaggcaagguucaguucugccuuguccccaguccccucauuuucaccugggucaccuauacucagaccagaggccagccuggggguuauuuauaacccugucagaggaagaggagacaggaaauuaggaauggguaagcggggaagagaaacaucgugccagugacccauuggauuggaaccuacagccuaacugccccgugugucugggccacaugauagggaauuuuuccuccccaguccaggcuaguuucaugugaccuccaaugcuaccugcagcucacuugccucuccccacccuauuucuguucuaugccaucaucaucaucaucauggguuccucugccuagaauggcucagggauuuuugucuucuaacaagguaauguacaggagcuaggggccagccaggaagccuagggccugagagaaggcgaguaggggacccaacucuaggagaguauacaguggacaagcucuccgcuguccccagcuguugucagcucugcccugcuucuuccuucgccuguugaaaaagccagacucagaauggucaacacucaggcgcucaagacuugauacuaacugcauuaagaugccucggaggagagguagcucaggcagaguuacacagcaguggggacagagccaggcuuggagcacugaccccuuuuccaaaccacugugcugccccaugggucccacaaaaauucucagcguauaaacauggauguaaguacucacagguugaaguguccagccuugcugugcucugagccauguucauggcagcugaauccuagcagaccaccucggguucucucagccauugcuuaccaaaacaccagaggcacugcucaaucagcaggcccguucccuucaggauaacuuuggguaaaguuaggcuccuuggagguuguuuuauuuuacuuggggcugcuuaauccucacacaauuauugucuaauucuccaagacaaauguucucaagauuauaaauguccuuaggaaagaaacacagaucaacuuaagccuucauacagcucaggaacucuugucugcgccuguccucacuaccuacccagaugaccuacaagaaauguuggauuucuaccccaaaggccgccuccacuccucugagccagacagagaggcagcuucaggaaggguccuagagcuacagagccugcaccaggucugaugggacacuaggaagcuacaaggaacuggauucugcaaacugcucuuagaacagcaaaagucuuuggagaagcagggagaaaccuuacugugcagcccaggguagccuguaacucacuguguagcucaggcuagaaccuagaauucaugguccuccugccucuuccuccugagugcuaggauugcaggugugugccaccacuaaaaccccaaaguuuugaugaccccaggaagccguucucauguuuucaaccuugaaggguaauuggaggcauagcagaaucaagggccaaagcacacugaacaugucuugccuggugucugaacuauaagcuguuaagaaaaaaauuuaaguaguugauauaaugacaacuaaaguugguaaaugaaguugguuagcaaagugcucuggccuucauggaacucagauaagccugggcagaaguucuuuguacacagagcaccaucuuccuggcaccauacccguacaaugacuccaguucaguauuugaguguuccuguaguucacccacauuuauugagcagcuacuaagugugauggccuguggucaggagcaccaagcgauuuccaggcagcagggcuauucuuagcuuucugaugucuauuuaaggaguguuaauccaucccaccucccccucugcaauuagacacauaccuccuuccaaccuuauaugcugagcucacccaacugccccagcugugcaggcaggauagacaagugugcuucccacucugcugggcuuggcucagcauuuaggcuuccugagccuggguagcuugggaauuggccaagccuggugagaaguguuugcuuugccuggacccuucaagaaguuuuggaggucagaauuccccaccuguuuuucucaacccuagagcacaguggggcagaaaaugugugaaccaagaacaggguagccugaguaugggagucgguagcuaaggguucagucugugggguagaccuccccauucagacauccacacccagccuugcaaucuagacagacaugugacaucauccaaccuagacaaugugaugucaucagagcccaucuccaccucucaugaguauauccaaauguaaaagccaagguugaccugugagccucacuugcccaaggacaagauaacuuccuggaaugcugggagcugcgguucuuggaaauaacaagccacguguuuucacucccauaagcaaguuugaaccgacuagaucagaugugcuugacuagauguaagcaggcuauacaucaggacauaggcuugauccugauugaaccugaugggaaauacagugaauuauggguuuuuccuuuuuaagcuucugugaaacaugacuuguggacauucccugggaacccaggaauaguccuggucaaggcccaucuuccucgcuguuauuuaauuaaagcuugcuuuaaauuuggcuccaaguuguggaacugguuuuuccucucaccauuuucagaacuaacaaaaguaccuagcaagccccuuccagccucaguauucccaccuaaaaagugggacaacgaugacaacaauauuaguuccaaacacguaagcuuauagccaauaauagaauuuccaugcauaaaaauauaaaguuauuaggacagcuguagccuugauacuuaacucuucuggaugucaauguucuaauaauaagaguuagaagugauaagguaugaguauauguuggccuauaauauuaauaauaauaacacauuaauaauauuaauauauuaauauugucaaauauuauucuuauuccagguguaucucuaaagccaaauugcuccaccucuguugaccuaguuuccuguuagucaaaugagaaaacugagucagauagcuuguacaaggucacccaggacaugagcuucccgccugggacuuucacguccugaagucucuucuggccaaauugagccaguagcuucugagcuuugguuagcaaaaaaugcauccccaucuuucccacacccugcaggcaagcugcuaaauacggaggguagugagaaaagaugccucauauucaaacgggauuuuggcuuguacucuccuuagcggcaugacauggcagcccuuaacaauggguggaugguaggauaacuggaaugcagccgcauauaacugacaugcacugacugugaaaacacacaaugcauuuuaaaaccuucacugcaaaacuggaaaaaugucaaaaguaauuuaaaauugauuacauggcaaaaugaucauacuuugaauacauuaguuaagcauagcguuaacuuagcauuaguuacguauggcauuaacuuagcauuaguuaaguauagcauuaacucuugcuuguuccuuuuauaaagugaccacuaugagaaaauuuuuaacggagugggagguuccccgugcuccuuccucggauggugcaggacgaggaguucuuccugcuugggaacuucucacagugagacucaaaggaaugugaacuauuuaggguuaaauuuuaaaacaaaauaggaagucaggugaggcauuaaguuuuaggaguguguggcaucuccagccuggauauguaaaaccuguuaaucugccaaaccaucccuugguguucuuuaccaccucagcaccugagcuccaauggucacugugguuuucauccauccugugugugugucugugugugugugacuguguguaccugcaugugaauguguguaugugugugggucuguaugugucuguauguguguggagggcuguauguauauguguguguauguguguuuguguauaugugccuguguguauauguauguguauaugugugugugaauguguguuuguguguguauguuguguauauguauguguauguguguauauguguguguuuguauauguaugucugcauauguguauguauauuuguguguuuguguguguuuguguguguauguauauguauguguguauaugcauguauguguauuugugcauuuguguguguguguguguguguguguguguguguguguguguguguguguuugaaggccaaaaguaaauguuggauaucuuccucauucgcucccuaccuuauuuuuugagacaaguucucuuacucaaccuggaacucagagguuagucuacacuggcugaucagcaagccuuggacauucuuuuguacucugcaucaggucuacgguuuuagaaucagaccauaauaccguuuuuuguuuguuuguuuuuaaugugggugcuggaaucugugcuuucaagcacuuuucugacugagccauuucccagccucuuucgcuguguuuuccaaguugaucacugcucuuuaauacagcagcuguuucucacugagcugcauggcaaaaccugauacuaucucuuuuucccaccacucccaagcugaggacacugcugccuagaaggacuggaugcugccuuuuucaaacauccccucauucauucacaaugacuuuacuaugugcacacuaacaucagaccagugaguaagacccaguucccauauaagggaggcaauaagacuaugucguaaucacgaggguugguauuuaccaagcccuuacuacaggcuaagcagcgagccaagacggcuguuuccaugaucucagugaauucccuccacagcccugugaagcgaacggucuucuuauacaugcaggguaacagagaggaaaagcaagaaugagauaggcuggcuugcccaagacauguaaccagcaaguaauaaagucaagaucugaggcaagcugguuaacaucacaaccuguauucuucaccagcucagaaacugggaaggacaugguaccaagaauguaggcugugaggaaaucauuuugcuucaaaagagccacuggccauauucauucugagaucugaggacuuaaagguuacucaagaggucaccagauacaaggucacaagaaaccuguaaccuacacagcugaaucaguguaugcuugugugugugugugugugugugugugugugugugugugugugugugugugugugauuuuacauuguaguaacacuuaaaaacuaaaguuucacccuagcacguugggguuuccagcuuauuauaagaaccuaaacaucuggccacacuguccccuuaccaaaggacauggauuuuccaguucaucacaguugccaccaguucuauugccucccugauaucaaggagaagaggagguacucaaagccaccacguagauauuuggggacaaauguggcaaacaagagacuggagacccuuauauguuuagcugauaguaguaauagucucacgugcuugauauuacaauaacccucccuuucuggcuagacaaugucagcaucagauuugugcccugaacuaauuaauuacaaagaaacccaagcuggaagauaaugagucaaaggggaucuggagcccacagccaccugcccacaagaggcauaguccccaucaugucuaucuauccagaucuguaucccaggcagcccuuuggguguugagcuucucacaaaucucaggccuuugggugucuguuuguccuuauuggagaggaaaguggagugggcuugcucagugaucacauguuugaccugaaacuuccagacuuucucucuuggaguaaacagacucguaugaaauaauaucacuuuuaauuagaggucuacaucuaagcuggucuuccagugggaaagucuuuucugcagcuuagaaggcuuccuaccaaacuguccagcagucagugacagacccugaagcgaccuugauuccgaauucuggccuuaagcuaagucugcaaggcugcugucuacagguaaaccagaugugauccaacaggaaguccgguggucccauagaucauugagcucagcucauuagauguguuuggguagaauccucacuauguucacagccacagagauccugaucugaucuuagcaggccauauuucuaaugaagcuuccuucaaagaguguuauuggcggcacuagguguuccauccugagcucugcuagauagcccuccccaaggaaaccugacccagaauacugacccaucguaauaaguaacauccaugcacaaaagaguagacacacacagucaguccuucacuuguccagaugagagaucaauuccuggggaggaucauaccaccaagguaauuccagagucagaugauaaacuugaggcagaccucagaucucauaacuggagaccagugaucucgucacaucaacacacaggaagcacgggcucucuagucccaagcuggguggagacaggaggaacugauuuguuauccaaguuuaauaucaccagcuucuagaacacucccuucagcuacucuaguaucuccacuucuuuccaccuaucagaaggaaaugugcuuagaagagucuaaauggggaagggcaaccccuaauccaugaauaccacuggacuuggucuucagaaggcaugggaucuacucuacagugaagcuacccagccauaccaccaauaucaguauugauagcuacccaaccacacauaccguaucaguauugauagccaucaagugggaacagugacccucccaccacccugcuuuuuuuuuuaaugugcauacuuagccaagcagcuuagcucaugaaaccuuaccaucacacuuucccccuugucacuuccccuugcccuagccugggucucacaaggaccugauauccgaauccaacagacuucucuucagguagccagguugccugccugggacaagcauuccugggaggacagaagcugugcagaaguuggggugaagagacuaacuaccuugugauguugaagaucugugcuucuagagcuugcucugcucaaggcucccccucucuacccuugcccugaauccccacaccuucacccccucaucccaucaucccagagcuauuagucacuggcugaacuuuaccguggcucucugaagccaaaccauuuucuucuccuucacccuuucuucugccagguggcacagaccuaguacuacuggaagucccuagugucccagaugugaaugacacggguaggugauaagaaauaugugacauuaaaucagaccugcaugucgggcagugcugugcaguggagacuacuccuuugguggcagccaggcugucucagucgcacagaagacuucuccaggccccucugcaucuccagacacacuucauuaaguaaaugagccaaagacccauuggucccaccacaguucggagacaucuuguggccuccugcuauaugcuaauuagcuagacccaagcuuagucuauuaugcugaugguguuucaaccugcuacacccaggccacauccucaaaggguauccaacacaaugggacccaggaacuucuugcuucuccacuaguccuggacacaucagguauaaugucagcgaagugacaagguccaugaccuuacuuagagaucuauacacucuucuaacacuucaguaggcucaggagagucccaagcguccuuugggcugcaaucaauuagcauggcagccaauauguccaacuugaaccugcuagcauuguggcaauuuucuguuuuaaacuguuuguuuauaggacugggaauagauacuccacacaugaagcugugaagcaauauccacugauggagaaguggauuuuaaaauauuuuucaguaucaagaaggauggauucaauaagggugaagauagagaucuaggcuagaaaucauggauuuuucguguggcuugguuccauuaagaacuccaaauaacuaacacuauaaugaaauugaggacagcagggaccagagaggcugucaaagggaauggccccagagcguuccaacagugugagucagagaccaaugugccaaaguugcacauuguugcaaaagaaggaggaccuucccuguucuagagagcugcguuucuuagucuccaggagaagagacccuaaaucuacaggagagaaugauccugaacacagucuuuggcgauauagcuucaggcugggcuguuucuugucugauguuaggcaggaaguuuuccuuuuucaaccugaggcuacugaguggguagcacaugagaaggaaugccucaucuuuacacaagugaggagcucagcccauggccguugugauaguaauugcaaccucaaugauaggucugauuaggaagaugcuguuguguuuguuccacuguaugguggggcuagaauuaucacauaagcagagaacaaaacaggugccucagcaggcuugugguucuggcuuugggaugaugcccucugggcaggccucauggaauuucagaggaguugacuuuuaguagaaaugguguccuacagauagcagaaaacaggaccaagugagacccagaaaaugagaaguucaugaggauguaugaugggaggaccuagcaugcaugggucaagagccggcagaaaacaggaucaccaggaaagcaggaaagaccaaugaagagaugggcagggcccauuaucaguccuuacaaaagccauuuuauuauaacuuuaccccauuaacccacugaagacuucuagucaggauggugggaucauuucuuaaagcagguuuccuaaugucaagaccccagagucuuucucugccaggcccacucugucucagcuauuuaccgccguccuugcagccauuuuauuuuuccauccaagcacuauccagaugagcaaucacugcaggaaggaacaaaggcaucagucuucuugcugucacccugagcccaacuaggggcacaaaagccuaugucccaguuucacacaugcacuuuugaaccugaguucaugcaaaaaccaaaguccaaacaaguuuccaguaaugaaaagcgcccuacguauuauaaaagcaaaagccuacagccaucucuaacuaaaguagcccagccacaagucaagagcuguggcuguccuaccacuuaagaccuucucuugguaugaaagugaucccauuaacuuggccuaaguggccuuaauuuuguucccuuucaaaaagauaaaaaggcugaccaaaagcagaagucgucagaauaccaaggaaaugucuaaaauuguuuuccauuugagagaagccugaauguaucugcagcacaacacugugcuauugccuccaucucccauccucugauugcaaaccuaaaaaggacagagucaacaugcagcucuggcgguggacugcagcaaagcugaaaauacaguguccuuccuucccaccaauacuuccaaauguacgcuugccauagaggcuucuccacgcacagcagcaaaagauaauauagugaccauguguucuagcacucuuaggaaggugaaaguuguuagaagcauagcuauccauaaauaggagauaucuaaauaaagugaugguagaucuaaaugaauauuauauugucauaguaauaucaccacauauagcacuauaaauguuauauagucuagcuggagacaccagagaggugggauacauggguguaaauacuagucucugcuacuuaccagguauagcacugaacaacuuacugaauuuuucugagcugcagcuuuuuucagugaagaugauaauaguacaucugccucguaggacuguugagagacuugaaugaacuaaugcauauuaauuauuuggaaugaugccuagcacacaguaaucauucuaucuuaaaacucagcauuggguuuuaaaaaaauuaucaucccauggaauacuaaggagagcaagacuacaauuacccacauguauauguauaucacucccugguauacaugauugaacagaaacgacaccaaggucacuccaguauucagucuucuaacuuuacaacuuucuaaugaagcaaaacuucugggaauguuccucggauaaugauguaaggaugcagauggagaauagaaagaaguaguauugauugaagcagcgauccaaagcgacuugcucuuucuuugauuuuguagagguggguagaugaagagauagggagguacauguauaaauggauggguggauggguggguggauggauggauggauggauagauagauagauagauagauagauagauagauagauagauagauagauagguagguagauagauaggauaaaugauacauaaacauaaaauaacacaucacuguaaaacuuuaagcuuaaaggcaugaauaaaaaaaggucugaaaguacaaauuacuguguccuuucaucacgaggagaguaaaggcugaaaggacccaauaaaagccuaaacacaaagccaacaagaugcugggguuggggaggggggaggaucugagcccagcugugcccuguccagggcucuuccaccaucccacauggccucuagagaccacccaagagcugaaugugacaaaagugguuagaaggggccuucguguccacauagcacaggcuaaaguguuaaaagccaaaggggacuggaaugguuuuuguuuuucauuaaugaaccuguuggaaugugccagucagcagcugagcucaauggcuccugcugugccagcaaagccacuucccagcccuguucuagucuugucugucaggggacugggaaagggacagaucagucagaggggcaccuucuacacccacgaggaccccagucugcagacuuccuuccugccucaugcuccacucauccaccucccacucagcacuggcagguggauccccugggaauccugucuccuacagucauccugcaaguuuggauucuaucagccuugcuguucgcuggucuuagugacacacaauuaguuucacucugaccuaauaauuuugagagucuuuucugguuuuaguagcuaaagaacauagggaauuuccuuuuuuuuuuuuuaauguuguuccguuauaaaacuauaaucaauucuuccuccguaaacaggauacuuaauuaaaacugcuggccccuuuagcugccuucaaagguuggaggaaagcuuuucuaaucuagaugaaaaugccaucugucccuuucauuuggauuccaggugcaggugccugccuuaggaugucagaagucagugcaagaugucagagguuagugaaaggucucaucaugaagacugaaugcaugccuggccacuacuggguggccuugcaugaucucauucagccucaguauuucccaucugagaaaugggugcaauaccacuuaagguugcuggggaguuaagauaguaccucuaacaugcuugcacacccaugcaagucugaaugcauccgucccuucuuuccucuugccuaacagcagucuuccucuggccaggauucucgagauacuauuagcauugguacacauggacaugcacacaugcacguacacgcacaccaccauccccacuaggugguugucaauucuccaaaguuccauaauuucauuuucuuugugucugucugccuguaggagugagagggcauaggucacguuugucuacaaauggcuucuuugcuaaaaccacuucagaucugaugcugaaggaacacgccccuggcaguggucccugucaaaacaacucaaugauaucagggcuauucuccaagguugucagcugcuccucccagacccagggcugacaccucuccacucccaccaaugccacugccuaauuacuccuugugaauggagacagagagaaggggguuuucucuacuacucccaccucugccaaaaccacacacacacacacacacacacacacacacacacacacacacacacacacacacacacaccaccccacuccaguuuucagaaugcucugaacauuucccauccuuccugaacuaagguggccagaacaaagucugccuggccaagccugccucuuucauucccagugcccuccccgcugcuucuucagucaagguuuugaaggaggagcaaggacuggaaggagaaggccccaggugaggcgacugcugccaagucucuuucuuugccccacaguguaucugauaagcgucuguguaguuuauucuucuaaacacuuuaauaggguacagggccugcaguugccauagaaacaccuuuuaacuccuccucauccagaagguugugccagucccauggguuuuggagaaaaaaaagagaaaagagacacccguggauaaagaaacagggagagggaaggccauuuugguguggugaugggggcuuaccaggggcccagcuaggcaugcugugcccuugccuggcagcauggcaucuggccagagugagaaugcuugaagguucuggaagaggaaggaggcagacgggcuugagcacacuuuccgagcuccaguuucccgaggacaguugggagccaucuacugguggcaacaggcagggugccugcugcugucaggcggcagcaggucaacaagccagcaggcccacacccacaccucccauuuuuaaaagcauuaucucaucucuugugcagugcaccaaacugaggguuagugagccuggaucccugccagagcaaggaucucucucucucucucucucucucucucucucucucucucucucucucucuguucuggguuuggcauauuucuugguaauuugacuuuguucuaggaagcauauuaagaggaaggaaaaaaaaaagcuguuucuugaauaaacccauagaaauuacaagaaacuuugucagucugacccacaguaggaccccaggagugcccacugggaacacgcucauguugucaaggccgaaaccucuaaucucuagguuagagaugagaacccucucucccuacucacacuaccaaaccaaacugaacacgccucgacccacugugaagcugaaaagagcuuggaccauagacugcacacccagauuccuccaccugcuagcucacaggccagcaccaggcucuaggcugagcaaaagcagacagcaggaacuaguagagaaagucaucggcuacugggaggaaagacuaagaggaaucugggugggggcccuaaugagagaagggagaaaacuuucccagcccuccagcaauccaaaaaaggaugcuugcaagcacuccauaaagccagggguucucccccagggacagagaagggugggugucucugggucccaggaaaccuucaagaagggugacugcagggucacacaaacacccugggcugccaaguggacugaccugaccaccaaaaccaccucccagauuucccccuaggccgacccaccagcagugccucuccaaccuugguuuucuuuccugccaggucaccaccccuccccccgccccccucucaacacaacacacuugcagaguagaaucccucacucaagacccaguggaaauuuuccaucuccuuuaugaccauacuuaaaacacacacacuccauucuuuacugacuccacacuggcuaagggcagccucuugucccaccccugcccagcaaacacacauuggaccugagagcuuuaaggagcuggagaagagaguagccagcuuccacuuccccuggagcccuccaaacacuaauguccccaacacuccucuggauaguggguucuacuucuuaucaagucccucuaaucagcacagucucuuugagaccaucaccacaagcgaugagaccuuuggcagcuuugcucuuuuggugacaaaucugcuuucuccgaugauacucacucucucccuccucacaaacauuccgggggaagaaaaaauauaucuuccugugaauuuucacagcucuaugauaagugauucccccacagucaccucaggccagcuaucaacacucugaugcaguucucccagggaggagggcaaucccacaguuuccgcccccccccuccccguuuuuuuuucaucucccccuccccccuuuuccagccacccaaacuuggcaggcaagaagcuccauuagcacuugccgggagagccugcagcuaggcugaguuucucaaggaaaagaaugaaguucaagggcgcgggagauaagcaaucuuugaagcuaggaguuuucucucucgcaacuccacccgcacagacuacaacuuguaaagugucgucgaggucccagaacuucaguuagcguuccaacuuuucagaaucucucacccuccuucuccagcucuuuucccuucaaggcaauggggaaauuuuucuagauaucaagcaggaccucguucacgcucgcccgccagagaccacuaggccacugguuggguucccucugcagggcaucuccccacacagaguccccgcccagggaaacugagucuuccggagcacuuaccgaugucggaguugcagaaggcauccuggggauggcugggagagcaugugcacgcuuccgcgccccagugcccaaggcuccagcagcucaggagcacgacaagcccaagccagggagucaugguagcuguugugguccgcugcggggacugccgcucuuuucuucaaaguugccgagcgcuagcgcugaugcuacaguccgagcucacucgcuggguuuaaccgggcacugugcacggugggcaacgaugagcuccggggaagugccuuccaaguagcccggcgggacaggacuaaguggccaagggucgcuggaacacgaguccgcggagccaacgaguggccucccggagaaggaucgggaagcggagaagcgggagaagaagauucuuggcgcuggcggcugcccgcugcccacugugagcgagaguccagggcugcagagugauauaggggcgcgaggggacccagccccucgggagcucgggguccgcccccuccgaccaauggcagcgccgcauuaccucaucggcccuccaaaaagggggcggggccggggggcgcg
